United States Patent
Gross et al.

(10) Patent No.: US 11,410,750 B2
(45) Date of Patent: Aug. 9, 2022

(54) METHYLATION MARKERS AND TARGETED METHYLATION PROBE PANEL

(71) Applicant: GRAIL, LLC, Menlo Park, CA (US)

(72) Inventors: Samuel S. Gross, Menlo Park, CA (US); Oliver Claude Venn, Menlo Park, CA (US); Seyedmehdi Shojaee, Menlo Park, CA (US); John Beausang, Menlo Park, CA (US); Arash Jamshidi, Menlo Park, CA (US)

(73) Assignee: GRAIL, LLC, Menlo Park, CA (US)

( * ) Notice: Subject to any disclaimer, the term of this patent is extended or adjusted under 35 U.S.C. 154(b) by 0 days.

(21) Appl. No.: 17/214,190

(22) Filed: Mar. 26, 2021

(65) Prior Publication Data

US 2021/0238694 A1    Aug. 5, 2021

Related U.S. Application Data

(63) Continuation of application No. PCT/US2019/053509, filed on Sep. 27, 2019, which
(Continued)

(51) Int. Cl.
| | |
|---|---|
| *G16B 40/00* | (2019.01) |
| *G16B 30/10* | (2019.01) |
| *G16B 5/00* | (2019.01) |
| *G16B 20/20* | (2019.01) |
| *G16B 40/20* | (2019.01) |
| G16B 25/20 | (2019.01) |
| G16B 20/00 | (2019.01) |
| C12Q 1/6886 | (2018.01) |

(52) U.S. Cl.
CPC ............... *G16B 40/00* (2019.02); *G16B 5/00* (2019.02); *G16B 20/20* (2019.02); *G16B 30/10* (2019.02); *G16B 40/20* (2019.02); *C12Q 1/6886* (2013.01); *C12Q 2600/154* (2013.01); *G16B 20/00* (2019.02); *G16B 25/20* (2019.02)

(58) Field of Classification Search
None
See application file for complete search history.

(56) References Cited

U.S. PATENT DOCUMENTS

| | | |
|---|---|---|
| 6,773,897 B2 | 8/2004 | Herman et al. |
| 6,773,987 B1 | 8/2004 | Rahim et al. |
| | (Continued) | |

FOREIGN PATENT DOCUMENTS

| | | |
|---|---|---|
| EP | 1309728 A2 | 5/2003 |
| EP | 1342794 B1 | 12/2005 |
| | (Continued) | |

OTHER PUBLICATIONS

Masser, D.R. et al. Bisulfite oligonucleotide-capture sequencing for targeted base and strand-specific absolute 5-methylcytosine quantitation, AGE (2016) 38: 49 (Year: 2016).*
(Continued)

*Primary Examiner* — Xiaoyun R Xu
(74) *Attorney, Agent, or Firm* — Greenberg Traurig, LLP

(57) ABSTRACT

The present description provides a cancer assay panel for targeted detection of cancer-specific methylation patterns. Further provided herein are methods of designing, making, and using the cancer assay panel for the diagnosis of cancer.

28 Claims, 29 Drawing Sheets

Specification includes a Sequence Listing.

Related U.S. Application Data is a continuation-in-part of application No. PCT/US2019/025358, filed on Apr. 2, 2019.

(60) Provisional application No. 62/737,836, filed on Sep. 27, 2018.

(56) References Cited

U.S. PATENT DOCUMENTS

| | | |
|---|---|---|
| 7,041,455 B2 | 5/2006 | Magness et al. |
| 7,371,526 B2 | 5/2008 | Zon et al. |
| 7,413,855 B2 | 8/2008 | Bergmann et al. |
| 7,655,399 B2 | 2/2010 | Cantor et al. |
| 7,700,282 B2 | 4/2010 | Tetzner et al. |
| 7,700,324 B1 | 4/2010 | Issa et al. |
| 7,749,702 B2 | 7/2010 | Lofton-Day et al. |
| 7,785,798 B2 | 8/2010 | Cantor et al. |
| 7,899,626 B2 | 3/2011 | Kruglyak et al. |
| 8,076,063 B2 | 12/2011 | Fan |
| 8,133,986 B2 | 3/2012 | Issa et al. |
| 8,137,937 B2 | 3/2012 | Markert-Hahn |
| 8,143,001 B2 | 3/2012 | Kurn et al. |
| 8,150,626 B2 | 4/2012 | Fan et al. |
| 8,318,433 B2 | 11/2012 | Brenner |
| 8,318,460 B2 | 11/2012 | Cantor et al. |
| 8,415,100 B2 | 4/2013 | Markowitz et al. |
| 8,455,190 B2 | 6/2013 | Makrigiorgos |
| 8,481,292 B2 | 7/2013 | Casbon et al. |
| 8,486,634 B2 | 7/2013 | Lim et al. |
| 8,541,207 B2 | 9/2013 | Kester |
| 8,586,310 B2 | 11/2013 | Mitra et al. |
| 8,673,555 B2 | 3/2014 | Taylor et al. |
| 8,728,764 B2 | 5/2014 | Boutell |
| 8,741,567 B2 | 6/2014 | He et al. |
| 8,771,939 B2 | 7/2014 | Tetzner et al. |
| 8,822,155 B2 | 9/2014 | Sukumar et al. |
| 8,865,410 B2 | 10/2014 | Shendure et al. |
| 8,880,350 B2 | 11/2014 | Von Hoff et al. |
| 8,900,829 B2 | 12/2014 | Distler et al. |
| 8,927,209 B2 | 1/2015 | Hamamoto et al. |
| 9,040,239 B2 | 5/2015 | Zheng et al. |
| 9,115,386 B2 | 8/2015 | Rao et al. |
| 9,121,061 B2 | 9/2015 | Vaisvila et al. |
| 9,121,069 B2 | 9/2015 | Lo et al. |
| 9,128,086 B2 | 9/2015 | Bawden et al. |
| 9,183,349 B2 | 11/2015 | Kupershmidt et al. |
| 9,200,260 B2 | 12/2015 | Correa, Jr. et al. |
| 9,222,937 B2 | 12/2015 | Micallef |
| 9,260,745 B2 | 2/2016 | Rava et al. |
| 9,267,117 B2 | 2/2016 | Guan et al. |
| 9,290,803 B2 | 3/2016 | Laird et al. |
| 9,290,807 B2 | 3/2016 | Booth et al. |
| 9,292,660 B2 | 3/2016 | Von Hoff et al. |
| 9,315,853 B2 | 4/2016 | Domanico et al. |
| 9,371,566 B2 | 6/2016 | Lo et al. |
| 9,394,332 B2 | 7/2016 | Markert-Hahn et al. |
| 9,400,276 B2 | 7/2016 | Micallef |
| 9,447,452 B2 | 9/2016 | Rao et al. |
| 9,464,277 B2 | 10/2016 | Zheng et al. |
| 9,476,095 B2 | 10/2016 | Vogelstein et al. |
| 9,580,754 B2 | 2/2017 | Markowitz et al. |
| 9,598,731 B2 | 3/2017 | Talasaz |
| 9,670,530 B2 | 6/2017 | Kostem et al. |
| 9,702,002 B2 | 7/2017 | Boutell |
| 9,702,004 B2 | 7/2017 | Van Eijk et al. |
| 9,732,390 B2 | 8/2017 | Lo et al. |
| 9,745,614 B2 | 8/2017 | Schroeder |
| 9,745,627 B2 | 8/2017 | Van Eijk et al. |
| 9,752,188 B2 | 9/2017 | Schmitt et al. |
| 9,816,986 B2 | 11/2017 | Rao et al. |
| 9,834,822 B2 | 12/2017 | Talasaz |
| 9,840,743 B2 | 12/2017 | Talasaz |
| 9,850,523 B1 | 12/2017 | Chudova et al. |
| 9,862,995 B2 | 1/2018 | Patel |
| 9,868,756 B2 | 1/2018 | Markert-Hahn et al. |
| 9,896,725 B2 | 2/2018 | Lee et al. |
| 9,896,726 B2 | 2/2018 | Vaisvila et al. |
| 9,902,992 B2 | 2/2018 | Talasaz et al. |
| 9,920,363 B2 | 3/2018 | Gao et al. |
| 9,920,366 B2 | 3/2018 | Eltoukhy et al. |
| 9,938,575 B2 | 4/2018 | Tischfield et al. |
| 9,984,201 B2 | 5/2018 | Zhang et al. |
| 10,011,878 B2 | 7/2018 | Ahlquist et al. |
| 10,031,131 B2 | 7/2018 | Rao et al. |
| 10,093,986 B2 | 10/2018 | Zhang et al. |
| 10,144,953 B2 | 12/2018 | Domanico et al. |
| 10,297,342 B2 | 5/2019 | Lo et al. |
| 10,392,666 B2 | 8/2019 | Lo et al. |
| 10,435,754 B2 | 10/2019 | Lo et al. |
| 10,435,755 B2 | 10/2019 | Ahlquist et al. |
| 10,704,083 B2 | 7/2020 | Domanico et al. |
| 10,718,026 B2 | 7/2020 | Weinhausel et al. |
| 2002/0192698 A1 | 12/2002 | Pinkel et al. |
| 2003/0104464 A1 | 6/2003 | Berlin et al. |
| 2005/0196792 A1 | 9/2005 | Fodor et al. |
| 2005/0221314 A1 | 10/2005 | Berlin et al. |
| 2006/0286576 A1 | 12/2006 | Lofton-Day et al. |
| 2006/0292585 A1 | 12/2006 | Nautiyal et al. |
| 2007/0141582 A1 | 6/2007 | Li et al. |
| 2007/0161031 A1 | 7/2007 | Trinklein et al. |
| 2008/0081338 A1 | 4/2008 | Lo et al. |
| 2008/0286787 A1 | 11/2008 | Campan et al. |
| 2008/0305481 A1 | 12/2008 | Whitman et al. |
| 2009/0280479 A1 | 11/2009 | Hoon et al. |
| 2010/0068720 A1 | 3/2010 | Li et al. |
| 2010/0120022 A1 | 5/2010 | Ayalon-Soffer et al. |
| 2010/0304978 A1 | 12/2010 | Deng et al. |
| 2011/0027771 A1 | 2/2011 | Deng |
| 2011/0165565 A1 | 7/2011 | Wang et al. |
| 2011/0237444 A1 | 9/2011 | Clancy et al. |
| 2012/0053062 A1 | 3/2012 | Brooks |
| 2012/0149593 A1 | 6/2012 | Hicks et al. |
| 2012/0157324 A1 | 6/2012 | Lizardi et al. |
| 2012/0190023 A1 | 7/2012 | Wasserstrom |
| 2012/0208711 A1 | 8/2012 | Cortese |
| 2012/0221249 A1 | 8/2012 | Lizardi et al. |
| 2013/0017958 A1 | 1/2013 | Benz et al. |
| 2013/0059734 A1 | 3/2013 | Molloy et al. |
| 2013/0129668 A1 | 5/2013 | Firestein et al. |
| 2013/0130924 A1 | 5/2013 | Walrafen et al. |
| 2013/0186639 A1 | 7/2013 | Zhao et al. |
| 2013/0203605 A1 | 8/2013 | Shendure et al. |
| 2013/0261984 A1 | 10/2013 | Eberle et al. |
| 2014/0024537 A1 | 1/2014 | Rigatti et al. |
| 2014/0080715 A1 | 3/2014 | Lo et al. |
| 2014/0256574 A1 | 9/2014 | Herold et al. |
| 2014/0274740 A1 | 9/2014 | Srinivasan et al. |
| 2014/0274748 A1 | 9/2014 | Ahlquist et al. |
| 2014/0274752 A1 | 9/2014 | Blume et al. |
| 2014/0274767 A1 | 9/2014 | Yegnasubramanian et al. |
| 2014/0342940 A1 | 11/2014 | Oliphant et al. |
| 2014/0357497 A1 | 12/2014 | Zhang et al. |
| 2014/0364323 A1 | 12/2014 | Fan et al. |
| 2015/0038352 A1 | 2/2015 | Cao et al. |
| 2015/0099670 A1 | 4/2015 | Li et al. |
| 2015/0104793 A1 | 4/2015 | Quake et al. |
| 2015/0159212 A1 | 6/2015 | Pantoja et al. |
| 2015/0197798 A1 | 7/2015 | Xu et al. |
| 2015/0197809 A1 | 7/2015 | Myers et al. |
| 2015/0209786 A1 | 7/2015 | Hage et al. |
| 2015/0259743 A1 | 9/2015 | Burgess et al. |
| 2015/0299781 A1 | 10/2015 | Ost |
| 2015/0322513 A1 | 11/2015 | Gromminger et al. |
| 2015/0368708 A1 | 12/2015 | Talasaz |
| 2016/0003848 A1 | 1/2016 | Holdenrieder |
| 2016/0017396 A1 | 1/2016 | Cann et al. |
| 2016/0017419 A1 | 1/2016 | Chiu et al. |
| 2016/0040229 A1 | 2/2016 | Talasaz et al. |
| 2016/0047001 A1 | 2/2016 | Larisch |
| 2016/0138079 A1 | 5/2016 | Guan et al. |
| 2016/0144378 A1 | 5/2016 | Huang et al. |
| 2016/0168648 A1 | 6/2016 | Allawi et al. |
| 2016/0186267 A1 | 6/2016 | So et al. |
| 2016/0210403 A1 | 7/2016 | Zhang et al. |
| 2016/0232290 A1 | 8/2016 | Rava et al. |

(56) References Cited

U.S. PATENT DOCUMENTS

| | | |
|---|---|---|
| 2016/0239604 A1 | 8/2016 | Chudova et al. |
| 2016/0251704 A1 | 9/2016 | Talasaz et al. |
| 2016/0258014 A1 | 9/2016 | Booth et al. |
| 2016/0265027 A1 | 9/2016 | Sanches-Kuiper et al. |
| 2016/0265042 A1 | 9/2016 | Schroeder et al. |
| 2016/0275240 A1 | 9/2016 | Huelga |
| 2016/0281175 A1 | 9/2016 | Weinhausel et al. |
| 2016/0298183 A1 | 10/2016 | Wen et al. |
| 2016/0319345 A1 | 11/2016 | Gnerre et al. |
| 2016/0333417 A1 | 11/2016 | Talasaz |
| 2016/0333420 A1 | 11/2016 | Stern et al. |
| 2016/0340740 A1 | 11/2016 | Zhang |
| 2016/0348152 A1 | 12/2016 | Zheng et al. |
| 2016/0362748 A1 | 12/2016 | Mongan et al. |
| 2017/0024513 A1 | 1/2017 | Lo et al. |
| 2017/0029900 A1 | 2/2017 | Lo et al. |
| 2017/0101685 A1 | 4/2017 | Lo et al. |
| 2017/0121767 A1 | 5/2017 | Dor et al. |
| 2017/0137871 A1 | 5/2017 | Lai et al. |
| 2017/0175205 A1 | 6/2017 | Toung et al. |
| 2017/0176420 A1 | 6/2017 | Rao et al. |
| 2017/0191119 A1 | 7/2017 | Rao et al. |
| 2017/0198344 A1 | 7/2017 | Vaisvila et al. |
| 2017/0211143 A1 | 7/2017 | Shendure et al. |
| 2017/0218338 A1 | 8/2017 | Rao et al. |
| 2017/0219589 A1 | 8/2017 | Rao et al. |
| 2017/0233829 A1 | 8/2017 | Lo et al. |
| 2017/0235877 A1 | 8/2017 | Lo et al. |
| 2017/0240973 A1 | 8/2017 | Eltoukhy et al. |
| 2017/0249421 A1 | 8/2017 | Eberle et al. |
| 2017/0260590 A1 | 9/2017 | Eltoukhy et al. |
| 2017/0275689 A1 | 9/2017 | Maguire |
| 2017/0292147 A1 | 10/2017 | Kostem et al. |
| 2017/0321276 A1 | 11/2017 | Cantor et al. |
| 2017/0327869 A1 | 11/2017 | Schutz et al. |
| 2017/0356053 A1 | 12/2017 | Otto et al. |
| 2017/0362638 A1 | 12/2017 | Chudova et al. |
| 2018/0010176 A1 | 1/2018 | Patel |
| 2018/0010192 A1 | 1/2018 | Zhang et al. |
| 2018/0023125 A1 | 1/2018 | Talasaz et al. |
| 2018/0044632 A1 | 2/2018 | Rao et al. |
| 2018/0044633 A1 | 2/2018 | Rao et al. |
| 2018/0044731 A1 | 2/2018 | Valouev et al. |
| 2018/0045727 A1 | 2/2018 | Spetzler et al. |
| 2018/0066306 A1 | 3/2018 | Namsaraev et al. |
| 2018/0082012 A1 | 3/2018 | Jiang et al. |
| 2018/0094325 A1 | 4/2018 | Zhang et al. |
| 2018/0105884 A1 | 4/2018 | Lo et al. |
| 2018/0119113 A1 | 5/2018 | Rao et al. |
| 2018/0119225 A1 | 5/2018 | Rao et al. |
| 2018/0119230 A1 | 5/2018 | Velculescu et al. |
| 2018/0120304 A1 | 5/2018 | Rao et al. |
| 2018/0171397 A1 | 6/2018 | Vaisvila et al. |
| 2018/0179587 A1 | 6/2018 | Rao et al. |
| 2018/0180602 A1 | 6/2018 | Rao et al. |
| 2018/0216195 A1 | 8/2018 | Elnitski et al. |
| 2018/0237867 A1 | 8/2018 | Bajic et al. |
| 2018/0327859 A1 | 11/2018 | Van Engeland et al. |
| 2019/0032149 A1 | 1/2019 | Van Engeland et al. |
| 2019/0136327 A1 | 5/2019 | Zhang et al. |
| 2019/0256921 A1* | 8/2019 | Mueller ............... G16B 99/00 |
| 2019/0287652 A1 | 9/2019 | Gross et al. |
| 2021/0017609 A1 | 1/2021 | Gross et al. |
| 2021/0025011 A1 | 1/2021 | Gross |

FOREIGN PATENT DOCUMENTS

| | | |
|---|---|---|
| EP | 1394173 B1 | 10/2007 |
| EP | 1644519 B1 | 12/2008 |
| EP | 1567669 B1 | 3/2010 |
| EP | 2771483 A1 | 9/2014 |
| EP | 2391729 B1 | 9/2016 |
| EP | 2825675 B1 | 12/2017 |
| EP | 3265562 A2 | 1/2018 |
| EP | 3087204 B1 | 2/2018 |
| EP | 3288455 A1 | 3/2018 |
| EP | 3094747 B1 | 11/2018 |
| EP | 2893040 B1 | 1/2019 |
| EP | 3497220 A1 | 6/2019 |
| EP | 3207134 B1 | 7/2019 |
| EP | 3218523 B1 | 2/2020 |
| EP | 3289097 B1 | 3/2020 |
| WO | WO-0181620 A2 | 11/2001 |
| WO | WO-2003054219 A2 | 7/2003 |
| WO | WO-2005017207 A2 | 2/2005 |
| WO | WO-2005019477 A2 | 3/2005 |
| WO | WO-2005118852 A2 | 12/2005 |
| WO | WO-2006128192 A2 | 11/2006 |
| WO | WO-2007106802 A2 | 9/2007 |
| WO | WO-2008038000 A1 | 4/2008 |
| WO | WO-2008048508 A2 | 4/2008 |
| WO | WO-2008073303 A2 | 6/2008 |
| WO | WO-2008084219 A1 | 7/2008 |
| WO | WO-2010037001 A2 | 4/2010 |
| WO | WO-2010085343 A1 | 7/2010 |
| WO | WO-2011038507 A1 | 4/2011 |
| WO | WO-2011127136 A1 | 10/2011 |
| WO | WO-2012031329 A1 | 3/2012 |
| WO | WO-2012138973 A2 | 10/2012 |
| WO | WO-2012149171 A1 | 11/2012 |
| WO | WO-2012178074 A1 | 12/2012 |
| WO | WO-2013060762 A1 | 5/2013 |
| WO | WO-2013163207 A1 | 10/2013 |
| WO | WO-2013186639 A2 | 12/2013 |
| WO | WO-2014026768 A1 | 2/2014 |
| WO | WO-2014043763 A1 | 3/2014 |
| WO | WO-2014135469 A2 | 9/2014 |
| WO | WO-2014151117 A1 | 9/2014 |
| WO | WO-2014184684 A2 | 11/2014 |
| WO | WO-2014205981 A1 | 12/2014 |
| WO | WO-2015101515 A2 | 7/2015 |
| WO | WO-2015116837 A1 | 8/2015 |
| WO | WO-2015124955 A1 | 8/2015 |
| WO | WO-2015145133 A1 | 10/2015 |
| WO | WO-2015153284 A1 | 10/2015 |
| WO | WO-2015179672 A1 | 11/2015 |
| WO | WO-2016008451 A1 | 1/2016 |
| WO | WO-2016015058 A2 | 1/2016 |
| WO | WO-2016016639 A1 | 2/2016 |
| WO | WO-2016034908 A1 | 3/2016 |
| WO | WO-2016063034 A1 | 4/2016 |
| WO | WO-2016063059 A1 | 4/2016 |
| WO | WO-2016094813 A1 | 6/2016 |
| WO | WO-2016097251 A1 | 6/2016 |
| WO | WO-2016101258 A1 | 6/2016 |
| WO | WO-2016115530 A1 | 7/2016 |
| WO | WO-2016127844 A1 | 8/2016 |
| WO | WO-2016127944 A1 | 8/2016 |
| WO | WO-2016141324 A2 | 9/2016 |
| WO | WO-2016170319 A1 | 10/2016 |
| WO | WO-2016179049 A1 | 11/2016 |
| WO | WO-2016189288 A1 | 12/2016 |
| WO | WO-2016210224 A1 | 12/2016 |
| WO | WO-2017008912 A1 | 1/2017 |
| WO | WO-2017012544 A1 | 1/2017 |
| WO | WO-2017027835 A1 | 2/2017 |
| WO | WO-2017048932 A1 | 3/2017 |
| WO | WO-2017062970 A1 | 4/2017 |
| WO | WO-2017083562 A1 | 5/2017 |
| WO | WO-2017106481 A1 | 6/2017 |
| WO | 2017127741 A1 | 7/2017 |
| WO | WO-2017136603 A1 | 8/2017 |
| WO | WO-2017176630 A1 | 10/2017 |
| WO | WO-2017181079 A2 | 10/2017 |
| WO | WO-2017181111 A2 | 10/2017 |
| WO | WO-2017181134 A2 | 10/2017 |
| WO | WO-2017181146 A1 | 10/2017 |
| WO | WO-2017181202 A2 | 10/2017 |
| WO | WO-2017194668 A1 | 11/2017 |
| WO | WO-2017201102 A1 | 11/2017 |
| WO | WO-2017212428 A1 | 12/2017 |
| WO | WO-2018005983 A1 | 1/2018 |
| WO | WO-2018009696 A1 | 1/2018 |
| WO | WO-2018009702 A1 | 1/2018 |

(56) References Cited

FOREIGN PATENT DOCUMENTS

| WO | WO-2018009703 A1 | 1/2018 |
|---|---|---|
| WO | WO-2018009705 A1 | 1/2018 |
| WO | WO-2018009709 A1 | 1/2018 |
| WO | WO-2018022890 A1 | 2/2018 |
| WO | WO-2018022906 A1 | 2/2018 |
| WO | WO-2018031760 A1 | 2/2018 |
| WO | WO-2018039463 A1 | 3/2018 |
| WO | WO-2018119216 A1 | 6/2018 |
| WO | WO-2018119452 A2 | 6/2018 |
| WO | WO-2018136881 A1 | 7/2018 |
| WO | WO-2018161031 A1 | 9/2018 |
| WO | WO-2018195211 A1 | 10/2018 |
| WO | WO-2018195217 A1 | 10/2018 |
| WO | WO-2018204764 A1 | 11/2018 |
| WO | 2019074700 A1 | 4/2019 |
| WO | WO-2019064063 A1 | 4/2019 |
| WO | WO-2019178277 A1 | 9/2019 |
| WO | WO-2019195268 A2 | 10/2019 |
| WO | WO-2019199696 A1 | 10/2019 |
| WO | WO-2020069350 A1 | 4/2020 |
| WO | WO-2020154682 A2 | 7/2020 |
| WO | 2020163403 A1 | 8/2020 |
| WO | 2020163410 A1 | 8/2020 |

OTHER PUBLICATIONS

AACRmeeting abstract in Apr. 2017, Liu et al., "Identify tissue-of-origin incancer cfDNA by whole genome sequencing" Abstract 5689/13.

Ashford, Molika. UCSD Methylation Haplotype Method Tracks cfDNA Origin; Singlera to Commercialize. Genome Web. Published Mar. 8, 2017. Accessed Dec. 7, 2020. Available at: https://www.genomeweb.com/molecular-diagnostics/ucsd-methylation-haplotype-method-tracks-cfdna-origin-singlera-commercialize#.X9POpmiQGUk.

Avraham, A. et al. Tissue Specific DNA Methylation in Normal Human Breast Epithelium and in Breast Cancer. PLOS One, 9(3):e91805:1-8 (Mar. 20, 2014).

Burnham, et al. Single-stranded DNA library preparation uncovers the origin and diversity of ultrashort cell-free DNA in plasma. Sci Rep. Jun. 14, 2016;6:27859. doi: 10.1038/srep27859.

Chan, K.C. et al. Noninvasive detection of cancer-associated genome-wide hypomethylation and copy number aberrations by plasma DNA bisulfite sequencing. Proc. Natl. Acad. Sci. USA 110(47):18761-18768 (Nov. 19, 2013).

Cheuk et al., Detection of Methylated Circulating DNA as Noninvasive Biomarkers for Breast Cancer Diagnosis. J. Breast Cancer 2017; 20(1): 12-17.

Chhibber et al. Single-molecule polymerase chain reaction reduces bias: Application to DNA methylation analysis by bisulfite sequencing. Anal. Biochem. vol. 377, Issue 1, Jun. 1, 2008, pp. 46-54.

clinicaltrials.gov [retrieved on Jun. 1, 2021], Retrieved from the Internet:www.clinicaltrials.gov/ct2/show/study/NCT02889978#armgroup.

Cohen, et al., Detection and localization of surgically resectable cancers with a multi-analyte blood test. Science Feb. 23, 2018:vol. 359, Issue 6378, pp. 926-930. DOI: 10.1126/science.aar3247.

Co-pending U.S. Appl. No. 17/214,038, inventors Gross; Samuel S. et al., filed Mar. 26, 2021.

Co-pending U.S. Appl. No. 17/214,105, inventors Gross; Samuel et al., filed Mar. 26, 2021.

Co-pending U.S. Appl. No. 17/214,682, inventors Xiang; Jing et al., filed Mar. 26, 2021.

Diep et al. Library-free methylation sequencing with bisulfite padlock probes. Nature Methods 9(3):270-272 (2012).

EZ DNA Methylation-Lightning Kit, Instruction Manual. Zymo Research, ver. 1.0.5.

Frimer et al. HPV16 methylation isa consistent biomarker of cervical intraepithelial neoplasia (CIN) 3 using anovel next-generation bisulfite-sequencing technology. GynecologicOncology. Jul. 2013, 130(1):e51-e52. Doi: https://doi.org/10.1016/j.ygyno.2013.04.182.

GenBank submission AC067721, Mar. 7, 2003 [online]. [Retrieved on Jun. 17, 2020].A Retrieved from the internet at< url: https://www.ncbi.nim.nih.gov/nuccore/AC067721 < /url:>.

GenBank submission AC093151.2, Jun. 25, 2002 [online]. [Retrieved on Jun. 17, 2020]. Retrieved from the internet at< url: https://www.ncbi.nlm.nih.gov/nuccore/AC093151 </url:>.

Guo, S. et al. Identification of methylation haplotype blocks aids in deconvolution of heterogeneous tissue samples and tumor tissue-of-origin mapping from plasma DNA. Nat Genet 2017;49:635-42.

Handbook of Chemistry and Physics, 49th Edition, 1968, Weast (ed.), The Chemical Rubber Co., Cleveland, Ohio, p. 245.

Hao et al. DNA methylation markers for diagnosis and prognosis of common cancers. PNAS USA 114(28):7414-7419 (w/Supplemental Information) (2017).

Huang et al., The Epigenome: Molecular Hide and Seek. Feb. 21, 2003, Chapter3, pp. 39-64. Doi: https://doi.org/10.1002/3527601511.ch3.

Husseiny, M. et al. Tissue-Specific Methylation of Human Insulin Gene and PCR Assay for Monitoring Beta Cell Death. PLoS ONE, 9(4):e9459:1-9 (Apr. 10, 2014).

Husseiny, M.I. et al. Development of a Quantitative Methylation-Specific Polymerase Chain Reaction Method for Monitoring Beta Cell Death in Type 1 Diabetes. PLoS One. PLOS ONE 7(10): e47942 (Oct. 29, 2012).

Kang et al., "CancerLocator: non-invasive cancer diagnosis and tissue-of-origin prediction using methylation profiles of cell-free DNA," Genome Biology vol. 18, Article No. 53 (2017).

Laird. Early Detection: The power and the promise of DNA methylation markers. Nat Rev Cancer 3:253-266 (2003).

Lebastchi, J. et al. Immune Therapy and β-Cell Death in Type 1 Diabetes. Diabetes, Brief Report 62(5):1676-1680 (May 2013).

Lehmann-Werman, et al. Identification of tissue-specific cell death using methylation patterns of circulating DNA. Proc Natl Acad Sci USA 2016;113:E1826-34.

Li et al. CancerDetector: ultrasensitive and non-invasive cancer detection at the resolution of individual reads using cell-free DNA methylation sequencing data. Nucleic Acids Research, vol. 46, Issue 15, Sep. 6, 2018, p. e89, https://doi.org/10.1093/nar/gky423.

Liu et al. Methylation-sensitive enrichment of minor DNA alleles using a double-strand DNA-specific nuclease. Nucleic Acids Research, 2017 vol. 45(6): e39.

Liu et al. Targeted methylation sequencing of plasma cell-free DNA for cancer detection and classification. Annals of Oncology 29: 1445-1453, 2018.

Madi, T. et al. The determination of tissue-specific DNAmethylation patterns in forensic biofluids using bisulfite modification andpyrosequencing. Electrophoresis,33(12):1736-1745 (Jul. 2012).

Miura et al., Highly sensitive targeted methylome sequencing by post-bisulfite adaptor tagging. DNA Research, vol. 22, Issue 1, Feb. 2015, pp. 13-18,https://doi.org/10.1093/dnares/dsu034.

Mouliere et al. Selecting short DNA fragments in plasma improves detection of circulating tumour DNA. May 2017. bioRxiv 134437; doi: https://doi.org/10.1101/134437.

Oncomine™ cfDNA Assays Part I: Library Preparation User Guide (2016).

Oncomine™cfDNA Assays part II: Plan a Run, Template Preparation, and Sequencing User Guide (2016).

PCT/US19/25358 International Search Report & Written Opinion dated Dec. 30, 2019.

PCT/US2019/053509 International Search Report dated Jan. 29, 2020.

Poon, Leo, L.M., et al., "Differential DNA Methylation between Fetus and Mother as a Strategy for Detecting Fetal DNA in Maternal Plasma," Clinical Chemistry, 2002, vol. 48, No. 1, pp. 35-41.

Raine, A. et al. Splinted Ligation Adapter Tagging (SPLAT), a novel library preparation method for whole genome bisulphite sequencing. Nucleic Acids Research, 110:1-15 (Nov. 28, 2016) .

Ross, JP et al. Identification of differentially methylated regions usign streptavidin bisulfite ligand methylation enrichment (SuBLiME),

(56) References Cited

OTHER PUBLICATIONS a new method to enrich for methylated DNA prior to deep bisulfite genomic sequencing. Epigenetics, 8(1):113-127 (Jan. 2013) E-pub: Dec. 20, 2012.
Shen et al., FACETS: allele-specific copy number and clonal heterogeneity analysis tool for high-throughput DNA sequencing. Nucleic Acids Research, 2016: 44(16) e131.
Shoemaker, et al., Allele-specific methylation is prevalent and is contributed by CpG-SNPs in the human genome. Genome Res. 2010.20:883-889.
Tanic, et al., Epigenome-wide association studies for cancer biomarker discovery in circulating cell-free DNA: technical advances and challenges. Current Opinion in Genetics & Development 2017, 42:48-55.
Toyota et al. Identification of differentially methylated sequences in colorectal cancer by methylated CpG island amplification. Cancer Research. May 1999. 59(10).
U.S. Appl. No. 17/061,013 Office Action dated Feb. 23, 2021.
U.S. Appl. No. 17/061,048 Office Action dated Feb. 1, 2021.
U.S. Appl. No. 17/061,048 Office Action dated Jun. 3, 2021.
Varley, K.E. et al. Bisulfite Patch PCR enables multiplexed sequencing of promoter methylation across cancer samples. Genome Research 20:1279-1287 (2010).
Vrba et al., "A suite of DNA methylation markers that can detect most common human cancers", EPIGENETICS, 2018, pp. 1-13.
Warton et al., Methylation of cell-free circulating DNA in the diagnosis of cancer. Frontiers in Mol. Bio. 2015; vol. 2, Art. 13.
Widschwendter, et al. Methylation patterns in serum DNA for early identification of disseminated breast cancer. Genome Medicine vol. 9, Article No. 115 (2017).
Yong, Ed. Written in Blood: DNA circulating in the bloodstream could guide cancer treatment—if researchers can work out how best to use it. Nature 2014: 511; 524-526.
Bejar, R., et al., Clinical Effect of Point Mutations in Myelodysplastic Syndromes, The New England Journal of Medicine, Jun. 2011, pp. 2496-2506.
Brandon, et al., "Mitochondrial mutations in cancer", Oncogene 25(34), 2006, pp. 4647-4662.
Genome Reference Consortium with a reference number, GRCh37/hg19, and also available from Genome Browser orovided by Santa Cruz Genomics Institute, Nucleic Acids Research, 2021, vol. 49, Nov. 22, 2020.
Harris, et al., "Single-Molecule DNA Sequencing of a Viral Genome", Science, vol. 320, 2008, 106-109.
Hashimoto, et al., "5'-end SAGE for the analysis of transcriptional start sites", Nature Biotechnology, 22, 2004, 1146-1149.
Illumina Data Sheet; Epigenetics "Infinfium HumanMethylation450 BeadChip", 4 pgs., 2012.
International Classification of Diseases for Oncology (ICD-O-3) (codes.iarc.fr) or the Surveillance, Epidemiology, and End Results Program (SEER) (sser.cancer.gov).
Kivioja, et al., "Counting absolute numbers of molecules using unique molecular identifiers", Nat Methods, 9(1), 2011, 72-4.
Li, et al., "Post-conversion targeted capture of modified cytosines in mammalian and plant genomes" NAR 43(12), e81, 16 pgs., 2015.
Mardis, E. R., et al., Recurring Mutations Found by Sequencing an Acute Myeloid Leukemia Genome, The New England Journal of Medicine, 2009, pp. 1058-1066.
Okamura, et al., "Lists of HumanMethylation450 BeadChip probes with nucleotide-variant information obtained from the Phase 3 data of the 1000 Genomes Project" Genomics Data, 7, pp. 67-69, 2016.
Papaemmanuil, E., et al., Somatic SF3B1 Mutation in Myelodysplasia with Ring Sideroblasts, The New England Journal of Medicine, Sep. 26, 2011, pp. 1384-1395.
Reidmiller M, Braun H. RPROP—A Fast Adaptive Learning Algorithm. Proceedings of the International Symposium on Computer and Information Science VII, 1992).
Surveillance, Epidemiology, and End Results Program (SEER) (seer.cancer.gov).
The STRIVE Study: Development of a Blood Test for Early Detection of Multiple Cancer Type, CinicalTrials.gov Identifier: NCT03085888, 6 pgs., 2017.
Walter, M., Clonal Architecture of Secondary Acute Myeloid Leukemia, The New England Journal of Medicine, , Mar. 14, 2012, pp. 1090-1098.
Zhai, et al.,"Genome-wide DNA Methylation Profiling of Cell-Free Serum DNA in Esophageal Adenocarcinoma and Barrett Esophagus" Neoplasia, 14(1), pp. 29-33, published Jan. 2012.

* cited by examiner

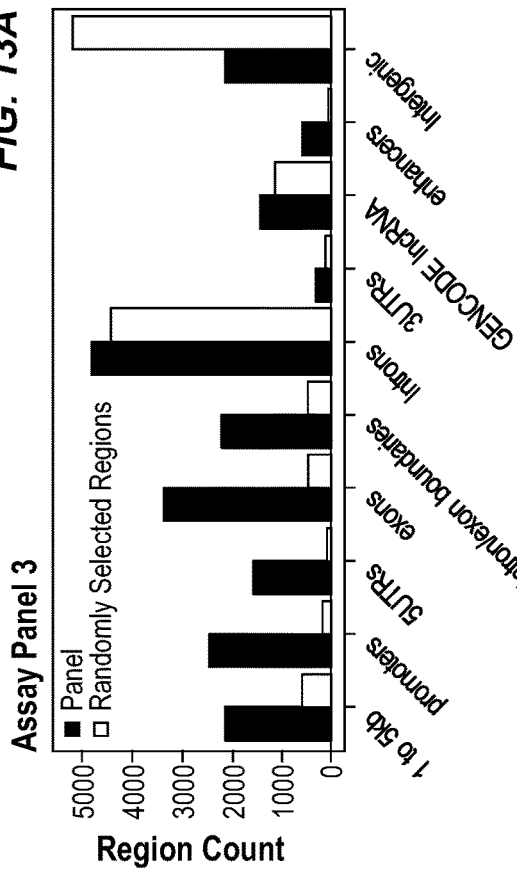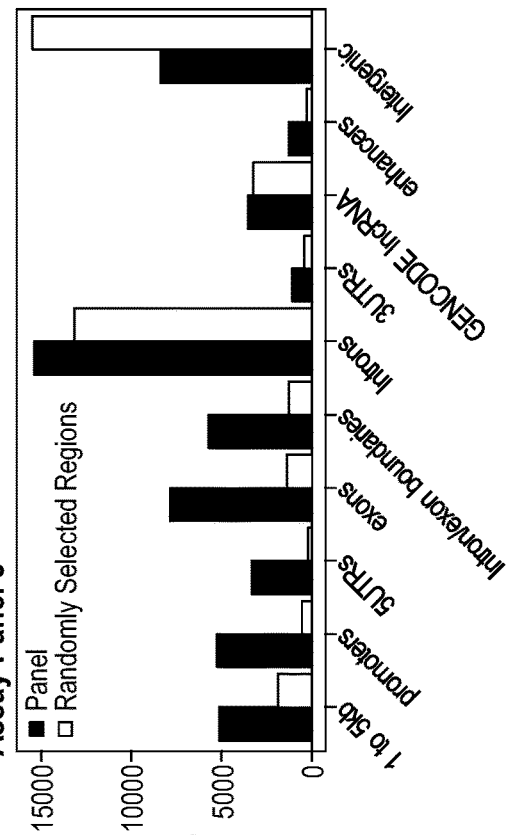

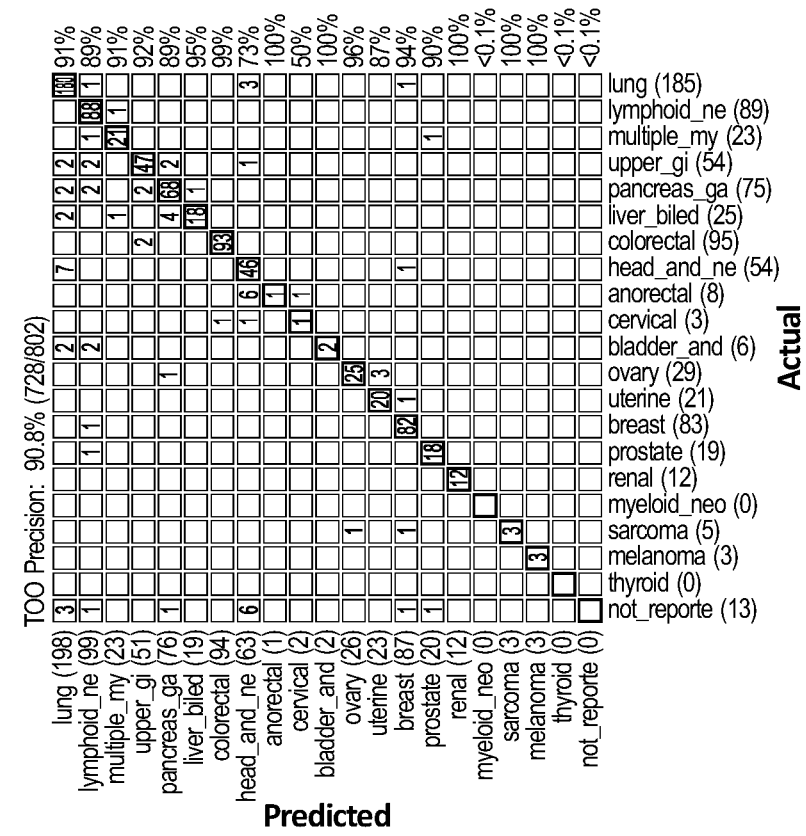
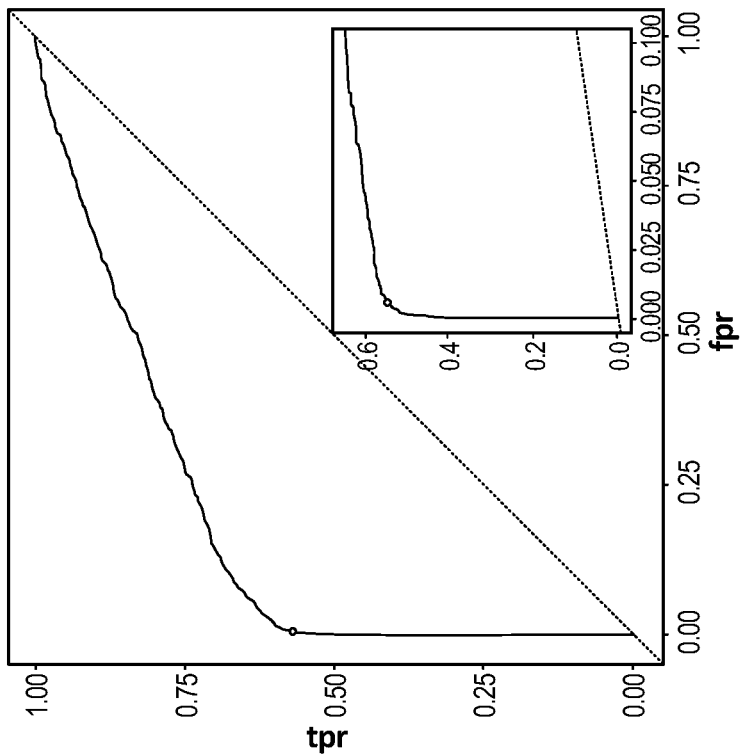
FIG. 19B
FIG. 19A

US 11,410,750 B2

METHYLATION MARKERS AND TARGETED METHYLATION PROBE PANEL

1. CROSS-REFERENCE

This is a continuation application of International Appl. No. PCT/US2019/053509, filed on Sep. 27, 2019, which claims the benefit of U.S. Provisional Application No. 62/737,836, filed Sep. 27, 2018, and also claims priority to continuation-in-part of International Appl. No. PCT/US2019/025358, filed on Apr. 2, 2019, both of which are hereby incorporated by reference in their entireties.

2. SEQUENCE LISTING

The instant application contains a Sequence Listing which has been submitted electronically in ASCII format and is hereby incorporated by reference in its entirety. Said ASCII copy, created on Sep. 26, 2019, is named 50251-846_01_SL.txt and is 52,371,626 bytes in size.

3. BACKGROUND

DNA methylation plays an important role in regulating gene expression. Aberrant DNA methylation has been implicated in many disease processes, including cancer. DNA methylation profiling using methylation sequencing (e.g., whole genome bisulfite sequencing (WGBS)) is increasingly recognized as a valuable diagnostic tool for detection, diagnosis, and/or monitoring of cancer. For example, specific patterns of differentially methylated regions may be useful as molecular markers for various diseases.

However, WGBS is not currently suitable for a product assay. The reason is that the vast majority of the genome is either not differentially methylated in cancer, or the local CpG density is too low to provide a robust signal. Only a few percent of the genome is likely to be useful in classification. With WGBS, deep sequencing (up to ~1000×) can be done in only a small set of genomic regions, perhaps 0.1% of the genome at current sequencing costs, because of cost constraints.

Furthermore, there have been various challenges in identifying differentially methylated regions in various diseases. First off, determining differentially methylated regions in a disease group only holds weight in comparison with a group of control subjects, such that if the control group is small in number, the determination loses confidence with the small control group. Additionally, among a group of control subjects, methylation status can vary which can be difficult to account for when determining the regions that are differentially methylated in a disease group. On another note, methylation of a cytosine at a CpG site is strongly correlated with methylation at a subsequent CpG site. To encapsulate this dependency is a challenge in itself.

Accordingly, a cost-effective method of accurately diagnosing a disease by analyzing DNA from differentially methylated regions has not yet been available.

4. SUMMARY

Early detection of cancer in subjects is important as it allows for earlier treatment and therefore a greater chance for survival. Targeted detection of cancer-specific methylation patterns using cell-free DNA (cfDNA) fragments can make early detection of cancer possible by providing cost-effective and non-invasive method for getting information relevant to detecting the presence or absence of cancer, a cancer tissue of origin, or cancer type. By using a targeted genomic region panel rather than sequencing all nucleic acids in a test sample, also known as "whole genome sequencing," the method can increase sequencing depth of the target regions.

Towards that end, the present description provides cancer assay panels (alternatively referred to as "bait sets") for detection of cancer-specific methylation patterns in targeted genomic regions, along with methods of using the cancer assay panels for diagnosis of cancer. Further provided herein are methods of designing and making the cancer assay panel by identifying genomic sites having cancer-specific methylation patterns as well as a list of genomic sites or genomic regions that can be used for various methods provided herein. The methods described herein further include methods of designing probes to enrich for cfDNA corresponding to or derived from selected genomic regions efficiently without pulling down an excessive amount of undesired DNA.

In one aspect, provided herein is a bait set for hybridization capture, the bait set comprising a plurality of different oligonucleotide-containing probes, wherein each of the oligonucleotide-containing probes comprises a sequence of at least 30 bases in length that is complementary to either: (1) a sequence of a genomic region; or (2) a sequence that varies from the sequence of (1) only by one or more transitions, wherein each respective transition of the one or more transitions occurs at a cytosine in the genomic region, and wherein each probe of the different oligonucleotide-containing probes is complementary to a sequence corresponding to a CpG site that is differentially methylated in cancer samples relative to non-cancer samples.

The bait set can comprise at least 500, 1,000, 2,000, 2,500, 5,000, 6,000, 7,500, 10,000, 15,000, 20,000, 25,000, 50,000 or 100,000 different oligonucleotide-containing probes. In one aspect, the CpG site is considered to be differentially methylated in cancer samples relative to non-cancer samples based on criteria comprising a number of cancer samples that comprise an anomalously methylated cfDNA fragment that overlaps the CpG site. In one aspect, the CpG site is considered to be differentially methylated in cancer samples relative to non-cancer samples based on criteria comprising $N_{cancer}$ and $N_{non-cancer}$, wherein: $N_{cancer}$ is a number of cancer samples that include a cfDNA fragment covering the CpG site that (1) has at least X CpG sites, wherein at least Y % of the CpG sites are methylated or unmethylated, wherein X is at least 4 and Y is at least 70, and (2) has a p-value rarity in non-cancerous samples of below a threshold value; and $N_{non-cancer}$ is a number of cancer samples that include a cfDNA fragment covering the CpG site that (1) has at least M CpG sites, wherein at least N % of the sites are methylated or unmethylated, wherein M is at least 4 and N is at least 70, and (2) has a p-value rarity in non-cancerous samples of below a threshold value. In one aspect, N equals X and N equals Y. In one aspect, the CpG site is considered to be differentially methylated based on criteria positively correlated with $N_{cancer}$ and negatively correlated with $N_{non-cancer}$. In one aspect, the CpG site is considered to be differentially methylated based on a ranked score of $(N_{cancer}+1)/(N_{cancer}+N_{non-cancer}+2)$.

In one aspect, in each of the different oligonucleotide-containing probes, the sequence of at least 30 bases in length can be complementary to either (1) a sequence within a genomic region selected from the genomic regions set forth in any one of Lists 1-8; or (2) a sequence that varies from the sequence of (1) only by one or more transitions, wherein each respective transition of the one or more transitions occurs at a cytosine in the genomic region. In one aspect, the plurality of different oligonucleotide-containing probes can be each conjugated to an affinity moiety. The affinity moiety can be biotin. In one aspect, for at least one of the different oligonucleotide-containing probes, the sequence of at least 30 bases can be complementary to the sequence that varies from the sequence of (1) only by one or more transitions, wherein each respective transition of the one or more transitions occurs at a cytosine in the genomic region. In another aspect, for at least 500, 1,000, 2,000, 2,500, 5,000, 6,000, 10,000, 15,000, 20,000, 25,000, or 50,000 of each of the different oligonucleotide-containing probes, the sequence of at least 30 bases can be complementary to the sequence that varies from the sequence of (1) only by one or more transitions, wherein each respective transition of the one or more transitions occurs at a cytosine in the genomic region. In one aspect, at least 80%, 90%, or 95% of the oligonucleotide-containing probes in the bait set do not include an at least 30, at least 40, or at least 45 base sequence that has 20 or more off-target regions of the genome. In another aspect, the oligonucleotide-containing probes in the bait set do not include an at least 30, at least 40, or at least 45 base sequence that has 20 or more off-targets regions of the genome. The sequence of at least 30 bases can be at least 40 bases, at least 45 bases, at least 50 bases, at least 60 bases, at least 75, or at least 100 bases in length. Each of the oligonucleotide-containing probes can have a nucleic acid sequence of at least 45, 40, 75, 100, or 120 bases in length. Each of the oligonucleotide-containing probes can have a nucleic acid sequence of no more than 300, 250, 200, or 150 bases in length.

In one aspect, the different oligonucleotide-containing probes comprise at least 500, at least 1000, at least 2,000, at least 2,500, at least 5,000, at least 6,000, at least 7,500, and least 10,000, at least 15,000, at least 20,000, or at least 25,000 different pairs of probes, wherein each pair of probes comprises a first probe and second probe, wherein the second probe differs from the first probe and overlaps with the first probe by an overlapping sequence that is at least 30, at least 40, at least 50, or at least 60 nucleotides in length. In one aspect, the bait set can include oligonucleotide-containing probes that are configured to target at least 20%, at least 25%, at least 30%, at least 40%, at least 50%, at least 60%, at least 70%, at least 80%, at least 90%, at least 95%, or 100% of the genomic regions identified in any one of Lists 1-8. In another aspect, the bait set can include oligonucleotide-containing probes that are configured to target at least 20%, at least 25%, at least 30%, at least 40%, at least 50%, at least 60%, at least 70%, at least 80%, at least 90%, at least 95%, or 100% of the genomic regions identified in List 1. The bait set can include oligonucleotide-containing probes that are configured to target at least 20%, at least 25%, at least 30%, at least 40%, at least 50%, at least 60%, at least 70%, at least 80%, at least 90%, at least 95%, or 100% of the genomic regions identified in List 3. An entirety of oligonucleotide probes in the bait set can be configured to hybridize to fragments obtained from cfDNA molecules corresponding to at least 30%, 40%, 50%, 60%, 70%, 80%, 90% or 95% of the genomic regions in a list selected from any one of Lists 1-8. An entirety of oligonucleotide-containing probes in the bait set can be configured to hybridize to fragments obtained from cfDNA molecules corresponding to at least 500, 1,000, 5000, 10,000, 15,000, 20,000, at least 25,000, or at least 30,000 genomic regions in any one of Lists 1-8. An entirety of oligonucleotide-containing probes in the bait set can be configured to hybridize to fragments obtained from cfDNA molecules corresponding to at least 50, 60, 70, 80, 90, 100, 120, 150, or 200 genomic regions in any one of Lists 1-8.

The plurality of oligonucleotide-containing probes can comprise at least 500, 1,000, 5,000, or 10,000 different subsets of probes, wherein each subset of probes comprises a plurality of probes that collectively extend across a genomic region selected from the genomic regions of any one of Lists 1-8 in a 2× tiled fashion. The plurality of probes that collectively extend across the genomic region in a 2× tiled fashion can comprise at least one pair of probes that overlap by a sequence of at least 30 bases, at least 40 bases, at least 50 bases, or at least 60 bases in length. The plurality of probes can collectively extend across portions of the genome that collectively can be a combined size of between 0.2 and 15 MB, between 0.5 MB and 15 MB, between 1 MB and 15 MB, between 3 MB and 12 MB, between 3 MB and 7, MB, between 5 MB and 9 MB, or between 7 MB and 12 MB. A subset of the different oligonucleotide-containing probes in the bait set can be designed to hybridize to cfDNA fragments derived from one or more genomics region from either List 4 or List 6. A subset of the different oligonucleotide-containing probes in the bait set can be designed to target at least 2, at least 10, at least 50, at least 100, at least 1000, or at least 5000, at least 8000, at least 10,000 or at least 20,000 of the genomic regions from either List 4 or List 6. The different oligonucleotide-containing probes can each comprise less than 20, 15, 10, 8, or 6 CpG detection sites. In one aspect, at least 80%, 85%, 90%, 92%, 95%, or 98% of the plurality of oligonucleotide-containing probes in the bait set can have exclusively either CpG or CpA on all CpG detection sites. The oligonucleotide-containing probes of the bait set can correspond with a number of genomic regions selected from the genomic regions of any one of Lists 1-8, wherein at least 30% of the genomic regions that correspond with the probes in the bait set are in exons or introns. The oligonucleotide-containing probes of the bait set can correspond with a number of genomic regions, wherein at least 15% or at least 20% of the genomic regions that correspond with probes in the bait set are in exons. The oligonucleotide-containing probes of the bait set can correspond with a number of genomic regions, wherein less than 10% of the genomic regions that correspond with probes in the bait set are intergenic regions. In one aspect, for each of the different oligonucleotide-containing probes, the at least 30 nucleotide sequence can be complementary to a sequence that varies from the sequence of the genomic region by one or more transitions at all CpG sites within the sequence. In another aspect, for oligonucleotide-containing probes that vary with respect to the sequence within the genomic region by one or more transitions, a transition can occur at each CpG site within the genomic region. The different oligonucleotide-containing probes can be complementary to cfDNA fragments that have been converted to replace cytosine with uracil, wherein the cfDNA fragments are found at least 2-fold, 10-fold, 20-fold, 50-fold, 100-fold, or 1000-fold more frequently in cfDNA from cancer subjects than from cfDNA from non-cancer subjects.

In one embodiment, provided herein is a mixture comprising a bait set and converted cfDNA. The converted cfDNA can comprise bisulfite-converted cfDNA. The converted cfDNA can comprise cfDNA that has been converted via cytosine deaminase. In one aspect, provided herein is a method for enriching a converted cfDNA sample comprising contacting the cell-free DNA sample with the bait set and enriching the sample for a first set of genomic regions by hybridization capture.

In another aspect, provided herein is a method for providing sequence information informative of a presence or absence of a cancer, a stage of cancer, or a type of cancer, the method comprising: processing cell-free DNA from a biological sample with a deaminating agent to generate a cell-free DNA sample comprising deaminated nucleotides; and enriching the cell-free DNA sample for informative cell-free DNA molecules, wherein enriching the cell-free DNA sample for informative cell-free DNA molecules comprises contacting the cell-free DNA with a plurality of probes that are configured to hybridize to cell-free DNA molecules that correspond to regions identified in any one of Lists 1-8; and sequencing the enriched cell-free DNA molecules, thereby obtaining a set of sequence reads informative of a presence or absence of a cancer, a stage of cancer, or a type of cancer. The plurality of probes can comprise a plurality of primers, and enriching the cell-free DNA comprises amplifying, via PCR, the cell-free DNA fragments using the primers. In one aspect, enriching the cell-free DNA does not involve hybridization capture. In one aspect, the plurality of probes can be configured to hybridize to converted fragments obtained from the cfDNA molecules corresponding to or derived from at least 30%, 40%, 50%, 60%, 70%, 80%, 90% or 95% of the genomic regions in any one of Lists 1-8. The plurality of probes can comprise a plurality of oligonucleotide-containing probes.

In another aspect, the method further comprises determining a cancer classification by evaluating the set of sequence reads, wherein the cancer classification is (a) a presence or absence of cancer; (b) a stage of cancer; or (c) a presence or absence of a type of cancer. The cancer classification can be a presence or absence of cancer. The cancer classification can be a stage of cancer. The stage of cancer can be selected from Stage I, Stage II, Stage III, and Stage IV. The cancer classification can be a presence or absence of a type of cancer. In one aspect, the step of determining a cancer classification can further comprise: (a) generating a test feature vector based on the set of sequence reads; and (b) applying the test feature vector to a classifier. In one aspect, the classifier further comprises a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The classifier can have an area under a receiver operating characteristic curve of greater than 0.70, greater than 0.75, greater than 0.77, greater than 0.80, greater than 0.81, greater than 0.82, or greater than 0.83. At 99% specificity, the classifier can have a sensitivity of at least 35%, at least 40%, at least 45% or at least 50%. In one aspect, the step of determining a cancer classification further comprises: (a) generating a test feature vector based on the set of sequence reads; and (b) applying the test feature vector to a classifier. In one aspect, the classifier comprises a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments.

In one aspect, the type of cancer can be selected from the group consisting of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In one aspect, the classifier, at 99.4% specificity, has a sensitivity of at least 70%, at least 80%, at least 85%, or at least 87% in classifying head and neck cancer. The classifier, at 99.4% specificity can have a sensitivity of at least 60%, at least 65%, at least 70%, or at least 73% in classifying liver/bile duct cancer. The classifier, at 99.4% specificity, can have a sensitivity of at least 70%, at least 75%, at least 80%, or at least 85% in classifying upper GI tract cancer. The classifier, at 99.4% specificity, can have a sensitivity of at least 70%, at least 80%, at least 85%, or at least 90% in classifying pancreatic/gall bladder cancer. The classifier, at 99.4% specificity can have a sensitivity of at least 70%, at least 80%, at least 90%, at least 95%, or at least 98% in classifying colorectal cancer. The classifier, at 99.4% specificity, can have a sensitivity of at least 70%, at least 80%, at least 85%, or at least 87% in classifying ovarian cancer. The classifier, at 99.4% specificity, can have a sensitivity of at least 70%, at least 80%, at least 90%, at least 95%, or at least 97% in classifying lung cancer. The classifier, at 99.4% specificity, can have a sensitivity of at least 70%, at least 80%, at least 85%, or at least 90% or at least 93% in classifying multiple myeloma. The classifier, at 99.4% specificity, can have a sensitivity of at least 70%, at least 80%, at least 90%, or at least 95% or at least 98% in classifying lymphoid neoplasm. The classifier, at 99.4% specificity, can have a sensitivity of at least 70%, at least 80%, at least 90%, or at least 95% or at least 98% in classifying melanoma. The classifier, at 99.4% specificity, can have a sensitivity of at least 35%, at least 40%, at least 45%, or at least 50% in classifying sarcoma. The classifier, at 99.4% specificity, can have a sensitivity of at least 70%, at least 80%, at least 90%, or at least 95% or at least 98% in classifying breast cancer. The classifier, at 99.4% specificity, can have a sensitivity of at least 70%, at least 80%, at least 90%, or at least 95% or at least 97% in classifying uterine cancer.

In another aspect, provided herein a method for determining a cancer classification comprising the steps of a) generating a test feature vector based on the set of sequence reads; and b) applying the test feature vector to a model obtained by a training process with a cancer set of fragments from one or more training subjects with a cancer and a non-cancer set of fragments from one or more training subjects without cancer, wherein both the cancer set of fragments and the non-cancer set of fragments comprise a plurality of training fragments. The training process can comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each training subject, generating a training feature vector based on the hypomethylated training fragments and hypermethylated training fragments, and (d) training the model with the training feature vectors from the one or more training subjects without cancer and the training feature vectors from the one or more training subjects with cancer. In another aspect, the training process comprises: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (d) for each training fragment, generating an aggregate hypomethylation score based on the hypomethylation score of the CpG sites in the training fragment and an aggregate hypermethylation score based on the hypermethylation score of the CpG sites in the training fragment; (e) for each training subject: ranking the plurality of training fragments based on aggregate hypomethylation score and ranking the plurality of training fragments based on aggregate hypermethylation score; and generating a feature vector based on the ranking of the training fragments; (f) obtaining training feature vectors for one or more training subjects without cancer and training feature vectors for the one or more training subjects with cancer; and (g) training the model with the feature vectors for the one or more training subjects without cancer and the feature vectors for the one or more training subjects with cancer. The model can comprise one of a kernel logistic regression classifier, a random forest classifier, a mixture model, a convolutional neural network, and an autoencoder model. In another aspect, the method further comprises the steps of: obtaining a cancer probability for the test sample based on the model; and comparing the cancer probability to a threshold probability to determine whether the test sample is from a subject with cancer or without cancer. The method can further comprise administering an anti-cancer agent to the subject.

In another aspect, provided herein is a method of treating a cancer patient, the method comprising, identified as a cancer subject by the methods above and administering an anti-cancer agent to a subject. The anti-cancer agent can be a chemotherapeutic agent selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, and platinum-based agents.

Provided herein is a method for assessing whether a subject has a cancer, the method comprising:

obtaining cfDNA from the subject; isolating a portion of the cfDNA from the subject by hybridization capture; obtaining sequence reads derived from the captured cfDNA to determine methylation states cfDNA fragments; applying a classifier to the sequence reads; and determining whether the subject has cancer based on application of the classifier; wherein the classifier has an area under the receiver operator characteristic curve of greater than 0.70, greater than 0.75, greater than 0.77, greater than 0.80, greater than 0.81, greater than 0.82, or greater than 0.83. In one aspect, the method further comprises converting unmethylated cytosines in the cfDNA to uracil prior to isolating the portion of the cfDNA from the subject by hybridization capture. In another aspect, the method further comprises converting unmethylated cytosines in the cfDNA to uracil after isolating the portion of the cfDNA from the subject by hybridization capture. The classifier can be a binary classifier. In one aspect, isolating a portion of the cfDNA from the subject by hybridization capture comprises contacting the cell-free DNA with a bait set comprising a plurality of different oligonucleotide-containing probes.

In another aspect, provided herein is a method for identifying genomic regions that exhibit differential methylation in cancer samples relative to non-cancer samples, the method comprising: (a) obtaining sequence reads of converted cfDNA from both cancer subjects and non-cancer subjects; (b) identifying, based on the sequence reads, cfDNA fragments that: (i) have a p-value rarity in non-cancerous samples of below a threshold value; and (ii) have at least X CpG sites, wherein at least Y % of the CpG sites are methylated, wherein X is at least 4, 5, 6, 7, 8, 9, or 10 and Y is at least 70; and (c) for each of a plurality of CpG sites in a reference genome, counting both (1) a number of cancer subjects ($N_{cancer}$) and (2) a number of non-cancer subjects ($N_{noncancer}$) that have a fragment identified in step (b); (d) for each of the plurality of CpG sites in the reference genome, determining whether the CpG site is differentially methylated in cancer samples based on criteria comprising $N_{cancer}$ and $N_{non-cancer}$; (e) identifying a genomic region as differentially methylated in cancer based, at least in part, on inclusion of a differentially methylated CpG site within the genomic region. In another aspect, provided herein is a method for identifying genomic regions that exhibit differential methylation in cancer samples relative to non-cancer samples, the method comprising:

(a) obtaining sequence reads of converted cfDNA from both cancer subjects and non-cancer subjects; (b) identifying, based on the sequence reads, cfDNA fragments that: (i) have at least X CpG sites, wherein at least Y % of the CpG sites are unmethylated, wherein X is 4, 5, 6, 7, 8, 9, or 10 and Y is at least 70; and (ii) have a p-value rarity in non-cancerous samples of below a threshold value;

(c) for each of a plurality of CpG sites in a reference genome, counting both (1) a number of cancer subjects ($N_{cancer}$) and (2) a number of non-cancer subjects ($N_{noncancer}$) that have a fragment identified in step (b); (d) for each of the plurality of CpG sites in the reference genome, determining whether the CpG site is differentially methylated in cancer samples based on criteria comprising $N_{cancer}$ and $N_{non-cancer}$; (e) identifying a genomic region as differentially methylated in cancer based, at least in part, on inclusion of a differentially methylated CpG site within the genomic region. In one aspect, the CpG site is considered to be differentially methylated based on criteria positively correlated with $N_{cancer}$ and negatively correlated with $N_{non-cancer}$. In one aspect, the CpG site is considered to be differentially methylated when $(N_{cancer+1})/(N_{cancer}+N_{non-cancer}+2)$ is greater than a threshold value. Each of the identified genomic regions can have at least X CpG sites, wherein X is 4, 5, or 6. In one aspect, at least 10%, at least 20%, at least 30%, at least 40%, at least 50%, at least 60%, at least 70%, at least 80%, or at least 90% of the identified regions are from any one of Lists 1-8.

In one aspect, provided herein is a method for developing a bait set for hybridization capture of cfDNA from genomic regions that are differentially methylated between cancer and non-cancer, the method comprising: identifying at least 1000, at least 5,000, at least 10,000, at least 25,000, or at least 30,000 differentially methylated genomic regions of the genome by comparison of one or more parameters derived from cfDNA fragments from cancer subject to one or more parameters derived from cfDNA fragments from non-cancer subjects; and designing, in silico, a plurality of oligonucleotide-containing probes that include a sequence of at least 30 bases in length that is complementary to either (1) a sequence of a genomic region or (2) a sequence that differs from the sequence of the genomic region only by one or more transitions, wherein each respective transition occurs at a cytosine in the genomic region. The method can further comprise removing, in silico, probes that have at least X off-target regions, wherein X is at least one. X can be at least 5, at least 10, or at least 20. The method can further comprise synthesizing the oligonucleotide-containing probes that were designed in silico.

In one aspect, provided herein is a method for selecting probes for hybridization capture of cfDNA, the method comprising: identifying a first set of genomic regions that are preferentially hypermethylated in cfDNA from cancer subjects relative to non-cancer subjects; identifying a second set of genomic regions that are preferentially hypomethylated in cfDNA from cancer subjects relative to non-cancer subjects; and selecting probes for hybridization capture of cfDNA corresponding to the first set of genomic regions and the second set of genomic regions, wherein the probes comprise a first set of probes for hybridization capture of cfDNA corresponding to the first set of genomic regions and a second set of probes for hybridization capture of cfDNA corresponding to the second set of genomic regions; wherein the probes comprise at least 500, at least 1,000, at least 2,500, at least 5,000, at least 10,000, at least 20,000 subsets of probes, wherein each subset of probes comprises a plurality of probes that extend across a genomic region in a 2× tiled fashion. The second set of probes for hybridization capture can comprise selecting probes that differ from a sequence in the genomic region only by one or more transitions, wherein each transition occurs at a nucleotide corresponding to a cytosine in the genomic region. In one aspect, selecting probes for hybridization capture can comprise filtering out probes that have more than a threshold number of off-target regions. Each subset of probes can comprise at least three probes. Each probe can be between 75 and 200, between 100 and 150, between 110 and 130, or 120 nucleotides in length.

In another aspect, provided herein is an assay panel for enriching cfDNA molecules for cancer diagnosis, the assay panel comprising: at least 500 different pairs of polynucleotide probes, wherein each pair of the at least 500 pairs of probes (i) comprises two different probes configured to overlap with each other by an overlapping sequence of 30 or more nucleotides and (ii) is configured to hybridize to a modified fragment obtained from processing of the cfDNA molecules, wherein each of the cfDNA molecules corresponds to or is derived from one or more genomic regions, wherein each of the one or more genomic regions comprises at least five methylation sites and has an anomalous methylation pattern in cancerous training samples relative to non-cancerous training samples. The overlapping sequence can comprise at least 40, 50, 75, or 100 nucleotides. The assay panel can comprise at least 1,000, 2,000, 2,500, 5,000, 6,000, 7,500, 10,000, 15,000, 20,000, or 25,000 pairs of probes.

In another aspect, provided herein is an assay panel for enriching cfDNA molecules for cancer diagnosis, the assay panel comprising: at least 1,000 polynucleotide probes, wherein each of the at least 1,000 probes is configured to hybridize to a modified polynucleotide obtained from processing of the cfDNA molecules, wherein each of the cfDNA molecules corresponds to or is derived from, one or more genomic regions, wherein each of the one or more genomic regions comprises at least five methylation sites, and has an anomalous methylation pattern in cancerous training samples relative to non-cancerous samples. The processing of the cfDNA molecules can comprise converting unmethylated C (cytosine) to U (uracil) in the cfDNA molecules. Each of the polynucleotide probes on the panel can be conjugated to an affinity moiety. The affinity moiety can be a biotin moiety. Each of the one or more genomic regions can be either hypermethylated or hypomethylated in the cancerous training samples relative to non-cancerous reference samples. In one aspect, at least 80%, 85%, 90%, 92%, 95%, or 98% of the probes on the panel can have exclusively either CpG or CpA on CpG detection sites. Each of the probes on the panel can comprise less than 20, 15, 10, 8, or 6 CpG detection sites. Each of the probes on the panel can be designed to have fewer than 20, 15, 10, or 8 off-target genomic regions. In one aspect, the fewer than 20 off-target genomic regions can be identified using a k-mer seeding strategy. In another aspect, the fewer than 20 off-target genomic regions can be identified using k-mer seeding strategy combined to local alignment at seed locations.

The assay panel can comprise at least 1,000, 2,000, 2,500, 5,000, 10,000, 12,000, 15,000, 20,000, or 25,000 probes. In one aspect, at least 500 pairs of probes or the at least 1,000 probes together can comprise at least 0.2 million, 0.4 million, 0.6 million, 0.8 million, 1 million, 2 million, 4 million, or 6 million nucleotides. Each of the probes on the panel can comprise at least 50, 75, 100, or 120 nucleotides. Each of the probes on the panel can comprise less than 300, 250, 200, or 150 nucleotides. Each of the probes on the panel can comprise 100-150 nucleotides. In one aspect, at least 30% of the genomic regions are in exons or introns. In another aspect, at least 15% of the genomic regions can be in exons. In another aspect, at least 20% of the genomic regions can be in exons. Each of the one or more genomic regions can be selected from one of Lists 1-8. An entirety of probes on the assay panel together can be configured to hybridize to modified fragments obtained from the cfDNA molecules corresponding to or derived from at least 30%, 40%, 50%, 60%, 70%, 80%, 90% or 95% of the genomic regions in one or more of Lists 1-8. An entirety of probes on the assay panel together are configured to hybridize to modified fragments obtained from the cfDNA molecules corresponding to or derived from at least 500, 1,000, 5000, 10,000 or 15,000 genomic regions in one or more of Lists 1-8. The processing of the cfDNA molecules can comprise converting unmethylated C (cytosine) to U (uracil) in the cfDNA molecules. Each of probes on the panel can be conjugated to an affinity moiety. The affinity moiety can be biotin. At least 80%, 85%, 90%, 92%, 95%, or 98% of the probes on the panel can have exclusively either CpG or CpA on CpG detection sites.

In another aspect, provided herein is a method of providing sequence information informative of a presence or absence of cancer, the method comprising the steps of: (a) obtaining a test sample comprising a plurality of cfDNA test molecules; (b) processing the cfDNA test molecules, thereby obtaining converted test fragments; (c) contacting the converted test fragments with an assay panel, thereby enriching a subset of the converted test fragments by hybridization capture; and (d) sequencing the subset of the converted test fragments, thereby obtaining a set of sequence reads. The converted test fragments can be bisulfite-converted test fragments. In another aspect, the method further comprises determining a cancer classification by evaluating the set of sequence reads, wherein the cancer classification is (a) a presence or absence of cancer; (b) a stage of cancer; (c) a presence or absence of a type of cancer. In one aspect, the step of determining a cancer classification can comprise: (a) generating a test feature vector based on the set of sequence reads; and (b) applying the test feature vector to a classifier. The classifier can comprise a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The classifier can have an area under a receiver operating characteristic curve of greater than 0.70, greater than 0.75, greater than 0.77, greater than 0.80, greater than 0.81, greater than 0.82, or greater than 0.83. At 99% specificity, the classifier can have a sensitivity of at least 35%, at least 40%, at least 45% or at least 50%. In another aspect, the step of determining a cancer classification further comprises: (a) generating a test feature vector based on the set of sequence reads; and (b) applying the test feature vector to a classifier. The classifier can comprise a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments.

The type of cancer can be selected from the group consisting of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In one aspect, the classifier, at 99.4% specificity, has a sensitivity of at least 70%, at least 80%, at least 85%, or at least 87% for classifying head and neck cancer. The classifier, at 99.4% specificity can have a sensitivity of at least 60%, at least 65%, at least 70%, or at least 73% for classifying liver/bile duct cancer. The classifier, at 99.4% specificity, can have a sensitivity of at least 70%, at least 75%, at least 80%, or at least 85% for classifying upper GI tract cancer. The classifier, at 99.4% specificity, can have a sensitivity of at least 70%, at least 80%, at least 85%, or at least 90% for classifying pancreatic/gall bladder cancer. The classifier, at 99.4% specificity can have a sensitivity of at least 70%, at least 80%, at least 90%, at least 95%, or at least 98% in classifying colorectal cancer. The classifier, at 99.4% specificity, can have a sensitivity of at least 70%, at least 80%, at least 85%, or at least 87% in classifying ovarian cancer. The classifier, at 99.4% specificity, can have a sensitivity of at least 70%, at least 80%, at least 90%, at least 95%, or at least 97% in classifying lung cancer. The classifier, at 99.4% specificity, can have a sensitivity of at least 70%, at least 80%, at least 85%, or at least 90% or at least 93% in classifying multiple myeloma. The classifier, at 99.4% specificity, can have a sensitivity of at least 70%, at least 80%, at least 90%, or at least 95% or at least 98% in classifying lymphoid neoplasm. The classifier, at 99.4% specificity, can have a sensitivity of at least 70%, at least 80%, at least 90%, or at least 95% or at least 98% in classifying melanoma. The classifier, at 99.4% specificity, can have a sensitivity of at least 35%, at least 40%, at least 45%, or at least 50% in classifying sarcoma. The classifier, at 99.4% specificity, can have a sensitivity of at least 70%, at least 80%, at least 90%, or at least 95% or at least 98% in classifying breast cancer. The classifier, at 99.4% specificity, can have a sensitivity of at least 70%, at least 80%, at least 90%, or at least 95% or at least 97% in classifying uterine cancer.

In one aspect, the method of cancer classification further comprises the steps of: (a) generating a test feature vector based on the set of sequence reads; and (b) applying the test feature vector to a model obtained by a training process with a cancer set of fragments from one or more training subjects with a cancer and a non-cancer set of fragments from one or more training subjects without cancer, wherein both the cancer set of fragments and the non-cancer set of fragments comprise a plurality of training fragments. The training process can comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each training subject, generating a training feature vector based on the hypomethylated training fragments and a training feature vector based on the hypermethylated training fragments, and (d) training the model with the training feature vectors from the one or more training subjects without cancer and the training feature vectors from the one or more training subjects with cancer. The training process can further comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (d) for each training fragment, generating an aggregate hypomethylation score based on the hypomethylation score of the CpG sites in the training fragment and an aggregate hypermethylation score based on the hypermethylation score of the CpG sites in the training fragment; (e) for each training subject: ranking the plurality of training fragments based on aggregate hypomethylation score and ranking the plurality of training fragments based on aggregate hypermethylation score; and generating a feature vector based on the ranking of the training fragments; (f) obtaining training feature vectors for one or more training subjects without cancer and training feature vectors for the one or more training subjects with cancer; and (g) training the model with the feature vectors for the one or more training subjects without cancer and the feature vectors for the one or more training subjects with cancer. The model can comprise one of a kernel logistic regression classifier, a random forest classifier, a mixture model, a convolutional neural network, and an autoencoder model. In one aspect, the method of cancer classification can further comprise the steps of: (a) obtaining a cancer probability for the test sample based on the model; and (b) comparing the cancer probability to a threshold probability to determine whether the test sample is from a subject with cancer or without cancer. In one aspect, the method of identifying a cancer subject can further comprise administering an anti-cancer agent to the subject. The anti-cancer agent can be a chemotherapeutic agent selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, and platinum-based agents.

In another aspect, provided herein is a method comprising the steps of: (a) obtaining a set of sequence reads of modified test fragments, wherein the modified test fragments are or have been obtained by processing a set of nucleic acid fragments from a test subject, wherein each of the nucleic acid fragments corresponds to or is derived from a plurality of genomic regions selected from any one of Lists 1-8; and (b) applying the set of sequence reads or a test feature vector obtained based on the set of sequence reads to a model obtained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The method can further comprise the step of obtaining the test feature vector comprising: (a) for each of the nucleic acid fragments, determining whether the nucleic acid fragment is hypomethylated or hypermethylated, wherein each of the hypomethylated and hypermethylated nucleic acid fragments comprises at least a threshold number of CpG sites with at least a threshold percentage of the CpG sites being unmethylated or methylated, respectively; (b) for each of a plurality of CpG sites in a reference genome: quantifying a count of hypomethylated nucleic acid fragments which overlap the CpG site and a count of hypermethylated nucleic acid fragments which overlap the CpG site; and generating a hypomethylation score and a hypermethylation score based on the count of hypomethylated nucleic acid fragments and hypermethylated nucleic acid fragments; (c) for each nucleic acid fragment, generating an aggregate hypomethylation score based on the hypomethylation score of the CpG sites in the nucleic acid fragment and an aggregate hypermethylation score based on the hypermethylation score of the CpG sites in the nucleic acid fragment; (d) ranking the plurality of nucleic acid fragments based on aggregate hypomethylation score and ranking the plurality of nucleic fragments based on aggregate hypermethylation score; and (e) generating the test feature vector based on the ranking of the nucleic acid fragments. The training process can comprise: (a) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (b) for each training subject, generating a training feature vector based on the hypomethylated training fragments and a training feature vector based on the hypermethylated training fragments, and (c) training the model with the training feature vectors from the one or more training subjects without cancer and the feature vectors from the one or more training subjects with cancer. The training process can comprise: (a) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (b) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (c) for each training fragment, generating an aggregate hypomethylation score based on the hypomethylation score of the CpG sites in the training fragment and an aggregate hypermethylation score based on the hypermethylation score of the CpG sites in the training fragment; (d) for each training subject:

ranking the plurality of training fragments based on aggregate hypomethylation score and ranking the plurality of training fragments based on aggregate hypermethylation score; and generating a feature vector based on the ranking of the training fragments; (e) obtaining training feature vectors for one or more training subjects without cancer and training feature vectors for the one or more training subjects with cancer; and (f) training the model with the feature vectors for the one or more training subjects without cancer and the feature vectors for the one or more training subjects with cancer.

In one aspect, the method can further comprise quantifying a count of hypomethylated training fragments which overlap that CpG site and a count of hypermethylated training fragments which overlap that CpG site for each CpG site in a reference genome comprising the steps of: (a) quantifying a cancer count of hypomethylated training fragments from the one or more training subjects with cancer that overlap that CpG site and a non-cancer count of hypomethylated training fragments from the one or more training subjects without cancer that overlap that CpG site; and (b) quantifying a cancer count of hypermethylated training fragments from the one or more training subjects with cancer that overlap that CpG site and a non-cancer count of hypermethylated training fragments from the one or more training subjects without cancer that overlap that CpG site. For each CpG site in a reference genome, generating a hypomethylation score and a hypermethylation score based on the count of hypomethylated training fragments and hypermethylated training fragments further comprises: (a) for generating the hypomethylation score, calculating a hypomethylation ratio of the cancer count of hypomethylated training fragments over a hypomethylation sum of the cancer count of hypomethylated training fragments and the non-cancer count of hypomethylated training fragments; and (b) for generating the hypermethylation score, calculating a hypermethylation ratio of the cancer count of hypermethylated training fragments over a hypermethylation sum of the cancer count of hypermethylated training fragments and the non-cancer count of hypermethylated training fragments. The model can comprise one of a kernel logistic regression classifier, a random forest classifier, a mixture model, a convolutional neural network, and an autoencoder model. In one aspect, the set of sequence reads can be obtained by using the assay panel described in this invention.

In one aspect, provided herein is a method of designing an assay panel for cancer diagnosis, comprising the steps of: (a) identifying a plurality of genomic regions, wherein each of the plurality of genomic regions (i) comprises at least 30 nucleotides, and (ii) comprises at least five methylation sites, (b) selecting a subset of the genomic regions, wherein the selection is made when cfDNA molecules corresponding to or derived from each of the genomic regions in cancer training samples have an anomalous methylation pattern, wherein the anomalous methylation pattern comprises at least five methylation sites known to be, or identified as, either hypomethylated or hypermethylated, and (c) designing the assay panel comprising a plurality of probes, wherein each of the probes is configured to hybridize to a modified fragment obtained from processing cfDNA molecules corresponding to or derived from one or more of the subset of the genomic regions. The processing of the cfDNA molecules can comprise converting unmethylated C (cytosine) to U (uracil) in the cfDNA molecules.

In another aspect, provided herein is a cancer assay panel, comprising: at least 500 pairs of probes, wherein each pair of the at least 500 pairs comprises two probes configured to overlap each other by an overlapping sequence, wherein the overlapping sequence comprises a 30-nucleotide sequence, and wherein the 30-nucleotide sequence is configured to have sequence complementarity with one or more genomic regions, wherein the one or more genomic regions have at least five methylation sites, and wherein the at least five methylation sites have an abnormal methylation pattern in non-cancerous samples or cancerous samples. The overlapping sequence comprises at least 40, 50, 75, or 100 nucleotides. The cancer assay panel can comprise at least 1,000, 2,000, 2,500, 5,000, 6,000, 7,500, 10,000, 15,000, 20,000 or 25,000 pairs of probes.

In another aspect, provided herein is a cancer assay panel, comprising: at least 1,000 probes, wherein each of the probes is designed as a hybridization probe complementary to one or more genomic regions, wherein each of the genomic regions comprises: (i) at least 30 nucleotides, and (ii) at least five methylation sites, wherein the at least five methylation sites have an abnormal methylation pattern and are either hypomethylated or hypermethylated in cancerous samples or non-cancerous samples. The abnormal methylation pattern can have at least a threshold p-value rarity in the non-cancerous samples. In one aspect, each of the probes is designed to have less than 20 off-target genomic regions. In one aspect, the less than 20 off-target genomic regions are identified using a k-mer seeding strategy. In another aspect, the less than 20 off-target genomic regions are identified using k-mer seeding strategy combined to local alignment at seed locations.

In one aspect, each of the genomic regions can be selected based on criteria comprising: (a) a number ($N_{cancer}$) of the cancerous samples including at least one cfDNA fragment having the abnormal methylation pattern; and (b) a number ($N_{non-cancer}$) of the non-cancerous samples including at least one cfDNA fragment having the abnormal methylation pattern. Each of the genomic regions can be selected based on criteria positively correlated to $N_{cancer}$ and inversely correlated to the sum of $N_{cancer}$ and $N_{non-cancer}$. comprising at least 1,000, 2,000, 2,500, 5,000, 10,000, 12,000, 15,000, 20,000, 30,000, 40,000, or 50,000 probes. In one aspect, the at least 500 pairs of probes or the at least 1,000 probes together comprise at least 0.2 million, 0.4 million, 0.6 million, 0.8 million, 1 million, 2 million, 3 million, 4 million, 5 million, or 6 million nucleotides. Each of the probes can comprise at least 50, 75, 100, or 120 nucleotides. Each of the probes can comprise less than 300, 250, 200, or 150 nucleotides. Each of the probes can comprise 100-150 nucleotides. Each of the probes can comprise less than 20, 15, 10, 8, or 6 methylation sites. In one aspect, at least 80%, 85%, 90%, 92%, 95%, or 98% of the at least five methylation sites are either methylated or unmethylated in the cancerous samples.

In one aspect, each of the probes is configured to have less than 20, 15, 10, or 8 off-target genomic regions. In one aspect, at least 30% of the genomic regions are in exons or introns. In another aspect, at least 15% of the genomic regions are in exons. In another aspect, at least 20% of the genomic regions are in exons. In another aspect, less than 10% of the genomic regions are in intergenic regions. The genomic regions can be selected from any one of Lists 1-8. The genomic regions can be selected from List 3. The genomic regions can be selected from List 8. The genomic regions can comprise at least 20%, 30%, 40%, 50%, 60%, 70%, 80%, 90% or 95% of the genomic regions in any one of Lists 1-8. The genomic regions can comprise at least 20%, 30%, 40%, 50%, 60%, 70%, 80%, 90% or 95% of the genomic regions in List 3. The genomic regions can comprise at least 20%, 30%, 40%, 50%, 60%, 70%, 80%, 90% or 95% of the genomic regions in List 5. The genomic regions can comprise at least 20%, 30%, 40%, 50%, 60%, 70%, 80%, 90% or 95% of the genomic regions in List 8. In one aspect, the at least 1,000 or at least 2,000 probes are configured to be complementary to at least 500, 1,000, 5000, 10,000 or 15,000 genomic regions in any one of Lists 1-8. In another aspect, the at least 1,000 or at least 2,000 probes are configured to be complementary to at least 500, 1,000, 5000, 10,000 or 15,000 genomic regions in List 3. In another aspect, the at least 1,000 or at least 2,000 probes are configured to be complementary to at least 500, 1,000, 5000, 10,000 or 15,000 genomic regions in List 5. In another aspect, the at least 1,000 or at least 2,000 probes are configured to be complementary to at least 1,000, 5000, 10,000 or 15,000 genomic regions in List 8. The 30-nucleotide sequence can comprise at least five CpG detection sites, wherein at least 80% of the at least five CpG detection sites comprise CpG, UpG, or CpA.

Provided herein is a cancer assay method comprising: receiving a sample comprising a plurality of nucleic acid fragments; treating the plurality of nucleic acid fragments to convert unmethylated cytosine to uracil, thereby obtaining a plurality of converted nucleic acid fragments; hybridizing the plurality of converted nucleic acid fragments with the probes on the cancer assay panel of any of above claims; enriching a subset of the plurality of converted nucleic acid fragments; and sequencing the enriched subset of the converted nucleic acid fragments, thereby providing a set of sequence reads. The method can further comprise the step of: determining a health condition by evaluating the set of sequence reads, wherein the health condition is (i) a presence or absence of cancer, or (ii) a stage of cancer. The set of nucleic acid fragments can be obtained from a human subject.

In another aspect, provided herein is a method for diagnosing cancer, comprising the steps of:

(a) obtaining a set of sequence reads by sequencing a set of nucleic acid fragments from a subject;

(b) determining methylation status of a plurality of genomic regions, the plurality of genomic regions comprise genomic regions selected from the genomic regions in any one of Lists 1-8; and (c) determining a health condition of the subject by evaluating the methylation status, wherein the health condition is (i) a presence or absence of cancer; or (ii) a stage of cancer. The genomic regions can be selected from List 3. The genomic regions can be selected from List 5. The genomic regions can be selected from List 8.

In another aspect, provided herein is a method for diagnosing cancer, comprising the steps of:

(a) obtaining a set of sequence reads by sequencing a set of nucleic acid fragments from a subject;

(b) determining methylation status of a plurality of genomic regions, the plurality of genomic regions comprise at least 20%, 30%, 40%, 50%, 60%, 70%, 80%, 90% or 95% of the genomic regions in any one of Lists 1-8; and (c) determining a health condition of the subject by evaluating the methylation status, wherein the health condition is (i) a presence or absence of cancer; or (ii) a stage of cancer. The genomic regions can comprise at least 20%, 30%, 40%, 50%, 60%, 70%, 80%, 90% or 95% of the genomic regions in List 3. The genomic regions can comprise at least 20%, 30%, 40%, 50%, 60%, 70%, 80%, 90% or 95% of the genomic regions in List 5. The genomic regions can comprise at least 20%, 30%, 40%, 50%, 60%, 70%, 80%, 90% or 95% of the genomic regions in List 8.

In another aspect, provided herein is a method for diagnosing cancer, comprising the steps of:

(a) obtaining a set of sequence reads by sequencing a set of nucleic acid fragments from a subject;

(b) determining methylation status of a plurality of at least 1,000, 2,000, 2,500, 5,000, 6,000, 7,500, 10,000, 15,000, 20,000 or 25,000 genomic regions among genomic regions in any one of Lists 1-8; and (c) determining a health condition of the subject by evaluating the methylation status, wherein the health condition is (i) a presence or absence of cancer; or (ii) a stage of cancer. In one aspect, at least 1,000, 2,000 probes can be configured to be complementary to at least 500, 1,000, 5000, 10,000 or 15,000 genomic regions in List 3. In one aspect, at least 1,000, 2,000 probes can be configured to be complementary to at least 500, 1,000, 5000, 10,000 or 15,000 genomic regions in List 5. In one aspect, at least 1,000, 2,000 probes can be configured to be complementary to at least 500, 1,000, 5000, 10,000 or 15,000 genomic regions in List 8.

In another aspect, provided herein is a method of designing a cancer assay panel comprising the steps of: identifying a plurality of genomic regions, wherein each of the plurality of genomic regions (i) comprises at least 30 nucleotides, and (ii) comprises at least five methylation sites, wherein the at least five methylation sites are either hypomethylated or hypermethylated, comparing methylation status of the at least five methylation sites in each of the plurality of genomic regions between cancerous samples and non-cancerous samples, selecting a subset of the genomic regions, wherein at least five methylation sites of the subset of the genomic regions have an abnormal methylation pattern in cancerous samples relative to non-cancerous samples, and designing a cancer assay panel comprising a plurality of probe sets, wherein each of the plurality of probe sets comprises at least a pair of probes configured to target one of the subset of the genomic regions. In one aspect, the abnormal methylation pattern matches that of a cfDNA fragment from the cancerous samples overlapping at least one of the at least five methylation sites, wherein the cfDNA has at least a threshold p-value rarity relative to a training data set of the non-cancerous samples. In one aspect, the method further comprises the step of selecting based on criteria comprising: (a) a number $N_{cancer}$ of the cancerous samples including cfDNA fragments having the abnormal methylation pattern; and (b) a number $N_{non-cancer}$ of the non-cancerous samples including cfDNA fragments having the abnormal methylation pattern. In one aspect, the step of selecting is based on criteria positively correlated to $N_{cancer}$ and inversely correlated to the sum of $N_{cancer}$ and $N_{non-cancer}$. Each of the plurality of probes can have less than 20, 15, 10 or 8 off-target genomic regions. In one aspect, the he less than 20, 15, 10, or 8 off-target genomic regions are identified using a k-mer seeding strategy. In one aspect, the less than 20, 15, 10 or 8 off-target genomic regions are identified using k-mer seeding strategy combined to local alignment at seed locations. The method can further comprise the step of making the cancer assay panel comprising the plurality of probes.

In another aspect, provided herein is a cancer assay panel comprising a plurality of probes made by the method described above. The subset of genomic regions in the cancer assay panel can comprise genomic regions of any one of Lists 1-8. The subset of genomic regions in the cancer assay panel can comprise genomic regions of List 3. The subset of genomic regions in the cancer assay panel can comprise genomic regions of List 5. The subset of genomic regions in the cancer assay panel can comprise genomic regions of List 8. The subset of the genomic regions in the cancer assay panel can comprise at least 20%, 30%, 40%, 50%, 60%, 70%, 80%, or 90% of the genomic regions in one or more of any one of Lists 1-8. The subset of the genomic regions in the cancer assay panel can comprise at least 20%, 30%, 40%, 50%, 60%, 70%, 80%, or 90% of the genomic regions in List 3. The subset of the genomic regions in the cancer assay panel can comprise at least 20%, 30%, 40%, 50%, 60%, 70%, 80%, or 90% of the genomic regions in List 5. The subset of the genomic regions in the cancer assay panel can comprise at least 20%, 30%, 40%, 50%, 60%, 70%, 80%, or 90% of the genomic regions in List 8. The subset of the genomic regions can comprise at least 500, 1,000, 5000, 10,000, 15,000, 20,000 or 25,000 genomic regions in any one of Lists 1-8. The subset of the genomic regions can comprise at least 500, 1,000, 5000, 10,000, 15,000, 20,000 or 25,000 genomic regions in List 3. The subset of the genomic regions can comprise at least 500, 1,000, 5000, 10,000, 15,000, 20,000 or 25,000 genomic regions in List 5. The subset of the genomic regions can comprise at least 500, 1,000, 5000, 10,000, 15,000, 20,000 or 25,000 genomic regions in List 8.

In another aspect, provided herein is a cancer assay panel comprising a plurality of probes, wherein each of the plurality of probes is configured to overlap with one of the genomic regions in any one of Lists 1-8, and the plurality of probes together overlap with at least 90%, 95% or 100% of the genomic regions in any one of Lists 1-8. In another aspect, provided herein is a cancer assay panel comprising a plurality of probes, wherein each of the plurality of probes is configured to overlap with one of the genomic regions in any one of Lists 1-8, and the plurality of probes together overlap with at least 500, 1,000, 5000, 10,000 or 15,000 genomic regions in any one of Lists 1-8.

The present description provides: a cancer assay panel comprising at least 500 pairs of probes, wherein each pair of the at least 500 pairs comprises two probes configured to overlap each other by an overlapping sequence, wherein the overlapping sequence comprises a 30-nucleotide fragment, the 30-nucleotide fragment comprises at least five CpG sites, wherein at least 80% of the at least five CpG sites comprise either CpG or at least 80% of the at least five CpG sites comprise UpG, and wherein the 30-nucleotide fragment is configured to bind to one or more genomic regions in cancerous samples, wherein the one or more genomic regions have at least five methylation sites, wherein the at least five methylation sites have an abnormal methylation pattern in non-cancerous samples or cancerous samples.

In some embodiments, the overlapping sequence comprises at least 40, 50, 75, or 100 nucleotides. In some embodiments, the cancer assay panel comprises at least 1,000, 2,000, 2,500, 5,000, 6,000, 7,500, 10,000, 15,000, 20,000 or 25,000 pairs of probes.

Another aspect of the present description provides a cancer assay panel, comprising: at least 1,000 probes, wherein each of the probes is designed as a hybridization probe complementary to one or more genomic regions, wherein each of the genomic regions comprises: (i) at least 30 nucleotides, and (ii) at least five methylation sites, wherein the at least five methylation sites have an abnormal methylation pattern and are either hypomethylated or hypermethylated in cancerous samples or non-cancerous samples.

In some embodiments, the abnormal methylation pattern has at least a threshold p-value rarity in the non-cancerous samples. In some embodiments, each of the probes is designed to be complementary to less than 20 off-target genomic regions.

In some embodiments, each of the genomic regions was selected based on criteria comprising: a number ($N_{cancer}$) of the cancerous samples including cfDNA fragments having the abnormal methylation pattern; and a number ($N_{non-cancer}$) of the non-cancerous samples including cfDNA fragments having the abnormal methylation pattern.

In some embodiments, each of the genomic regions was selected based on criteria positively correlated to $N_{cancer}$ and inversely correlated to the sum of $N_{cancer}$ and $N_{non-cancer}$.

In some embodiments, the cancer assay panel comprises at least 1,000, 2,000, 2,500, 5,000, 10,000, 12,000, 15,000, 20,000, 30,000, 40,000, 50,000, or 100,000 probes. In some embodiments, the at least 1,000 pairs of probes or the at least 2,000 probes together comprise at least 0.2 million, 0.4 million, 0.6 million, 0.8 million, 1 million, 2 million, 3 million, 4 million, 5 million, 6 million nucleotides, 7 million nucleotides, 8 million nucleotides, 9 million nucleotides, or 10 million nucleotides. In some embodiments, each of the probes comprises at least 50, 75, 100, or 120 nucleotides. In some embodiments, each of the probes comprises less than 300, 250, 200, or 150 nucleotides. In some embodiments, each of the probes comprises 100-150 nucleotides. In some embodiments, each of the probes comprises less than 20, 15, 10, 8, or 6 methylation sites. In some embodiments, at least 80%, 85%, 90%, 92%, 95%, or 98% of the at least five methylation sites are either methylated or unmethylated in the cancerous samples. In some embodiments, each of the probes is configured to be complementary to less than 20, 15, 10 or 8 off-target genomic regions.

In some embodiments, at least 15%, 20%, 30%, or 40% of the genomic regions are in exons or introns. In some embodiments, at least 5%, 10%, 15%, 20%, 30% or 40% of the genomic regions are in exons. In some embodiments, less than 5%, 10%, 15%, 20%, 25%, or 30% of the genomic regions are in intergenic regions. In some embodiments, between 20% and 60%, between 30% and 50%, or between 35% and 55% of the genomic regions are in introns or exons. In some embodiments, between 5% and 30% between 10% and 25%, or between 12% and 20% of the genomic regions are in exons. In some embodiments, between 5% and 20% of the genomic regions are in intergenic regions.

In some embodiments, the genomic regions are selected from any one of Lists 1-8. In some embodiments, the genomic regions comprise at least 20%, 30%, 40%, 50%, 60%, 70%, 80%, 90% or 95% of the genomic regions in any one of Lists 1-8. In some embodiments, the at least 1,000 probes are configured to be complementary to at least 500, 1,000, 5000, 10,000 or 15,000 genomic regions in any one of Lists 1-8.

In another aspect, the present description provides a cancer assay method comprising receiving a sample comprising a plurality of nucleic acid fragments; treating the plurality of nucleic acid fragments to convert unmethylated cytosine to uracil, thereby obtaining a plurality of converted nucleic acid fragments; hybridizing the plurality of converted nucleic acid fragments with the probes on the cancer assay panel of any of the above claims; enriching a subset of the converted nucleic acid fragments; and sequencing the enriched subset of the converted nucleic acid fragments, thereby providing a set of sequence reads.

In some embodiment, the method further comprises the step of determining a health condition by evaluating the set of sequence reads, wherein the health condition is a presence or absence of cancer and/or, cancer stage.

In some embodiments, the set of nucleic acid fragments is obtained from a human subject.

In other aspect, the present description provides a method of diagnosing cancer, comprising the steps of: (a) obtaining a set of sequence reads by sequencing a set of nucleic acid fragments from a subject; (b) determining methylation status of a plurality of genomic regions, the plurality of genomic regions comprise genomic regions of any one of Lists 1-8; and (c) determining a health condition of the subject by evaluating the methylation status, wherein the health condition is (i) a presence or absence of cancer; or (ii) a stage of cancer. In other aspect, the present description provides a method for diagnosing cancer, comprising the steps of: (a) obtaining a set of sequence reads by sequencing a set of nucleic acid fragments from a subject; (b) determining methylation status of a plurality of genomic regions, the plurality of genomic regions comprise at least 20%, 30%, 40%, 50%, 60%, 70%, 80%, 90% or 95% of the genomic regions in any one of Lists 1-8; and (c) determining a health condition of the subject by evaluating the methylation status, wherein the health condition is (i) a presence or absence of cancer; or (ii) a stage of cancer. In other aspects, the present description provides a method for diagnosing cancer, comprising the steps of: (a) obtaining a set of sequence reads by sequencing a set of nucleic acid fragments from a subject; (b) determining methylation status of a plurality of at least 1,000, 2,000, 2,500, 5,000, 6,000, 7,500, 10,000, 15,000, 20,000 or 25,000 genomic regions among genomic regions in any one of Lists 1-8; and (c) determining a health condition of the subject by evaluating the methylation status, wherein the health condition is (i) a presence or absence of cancer; or (ii) a stage of cancer.

Yet another aspect provides a method of designing a cancer assay panel comprising the steps of: identifying a plurality of genomic regions, wherein each of the plurality of genomic regions (i) comprises at least 30 nucleotides, and (ii) comprises at least five methylation sites, comparing methylation status of the at least five methylation sites in each of the plurality of genomic regions between cancerous samples and non-cancerous samples, wherein the at least five methylation sites are either hypomethylated or hypermethylated, selecting a subset of the genomic regions, wherein at least five methylation sites of the subset of the genomic regions have an abnormal methylation pattern in cancerous samples relative to non-cancerous samples, and designing a cancer assay panel comprising a plurality of probe sets, wherein each of the plurality of probe sets comprises at least a pair of probes configured to target (e.g., to be complementary to either converted or non-converted fragments corresponding to) one of the subset of the genomic regions.

In some embodiments, the abnormal methylation pattern matches that of a cfDNA fragment from the cancerous samples overlapping at least one of the at least five methylation sites, wherein the cfDNA has at least a threshold p-value rarity relative to a training data set of the non-cancerous samples.

In some embodiments, the step of selecting is performed based on criteria comprising: a number $N_{cancer}$ of the cancerous samples including cfDNA fragments having the abnormal methylation pattern; and a number $N_{non-cancer}$ of the non-cancerous samples including cfDNA fragments having the abnormal methylation pattern. In some embodiments, the step of selecting is based on criteria positively correlated to $N_{cancer}$ and inversely correlated to the sum of $N_{cancer}$ and $N_{non-cancer}$.

In some embodiments, each of the plurality of probes has less than 20, 15, 10 or 8 off-target genomic regions. In some embodiments, the method further comprises the step of: making the cancer assay panel comprising the plurality of probes.

Another aspect of the present description provides a cancer assay panel made by the method provided herein. In some embodiments, the subset of genomic regions comprises genomic regions of any one of Lists 1-8. In some embodiments, the subset of the genomic regions comprises at least 20%, 30%, 40%, 50%, 60%, 70%, 80%, or 90% of the genomic regions in any one of Lists 1-8. In some embodiments, the subset of the genomic regions comprises at least 500, 1,000, 5000, 10,000 or 15,000 genomic regions in any one of Lists 1-8.

Another aspect of the present description provides a cancer assay panel comprising a plurality of probes, wherein each of the plurality of probes is configured to overlap with one of the genomic regions in any one of Lists 1-8, and the plurality of probes together overlap with at least 90%, 95% or 100% of the genomic regions in any one of Lists 1-8. In yet another aspect, the present description provides a cancer assay panel comprising a plurality of probes, wherein each of the plurality of probes is configured to overlap with one of the genomic regions in any one of Lists 1-8, and the plurality of probes together overlap with at least 500, 1,000, 5000, 10,000 or 15,000 genomic regions in any one of Lists 1-8.

5. BRIEF DESCRIPTION OF THE DRAWINGS

Figure 8A:
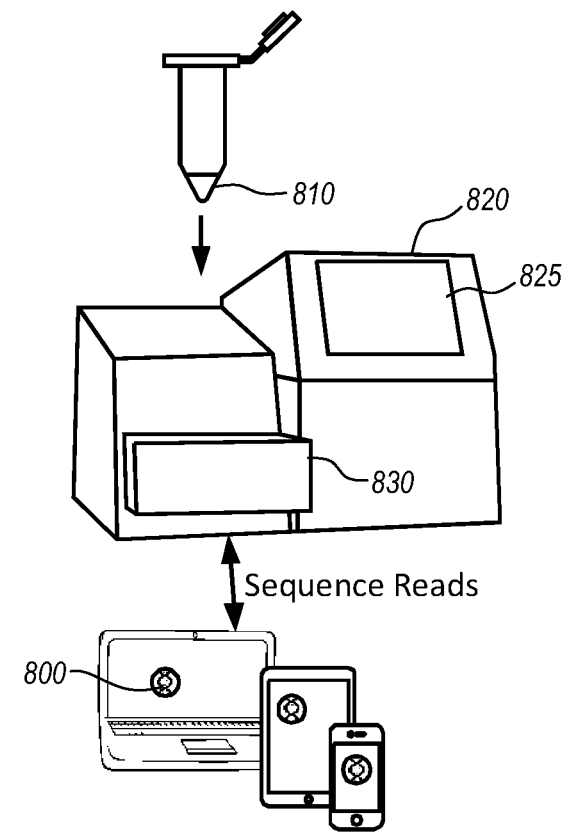
FIG. 8A is a flowchart of devices for sequencing nucleic acid samples according to one embodiment.
Figure 8B:
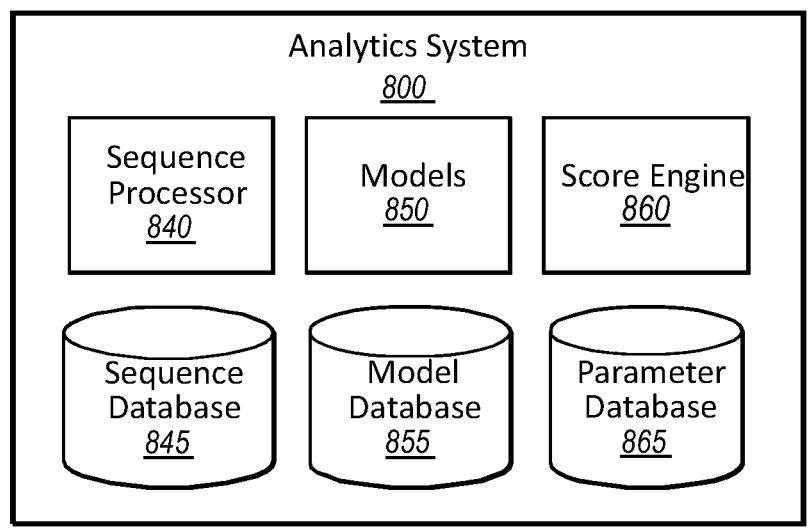

FIG. 8B provides an analytic system that analyzes methylation status of cfDNA according to one embodiment.

Figure 9A:
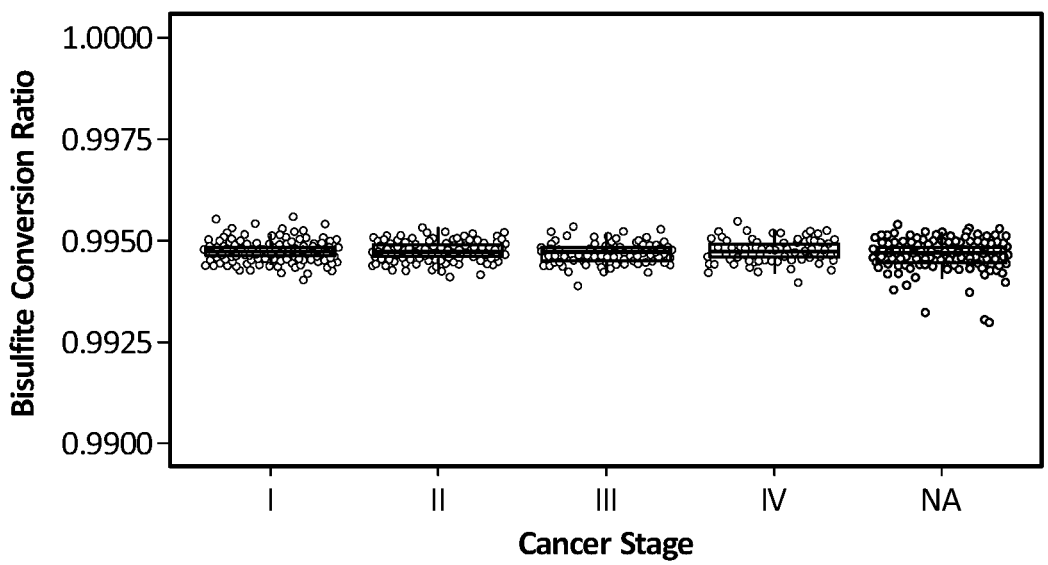
Figure 9B:
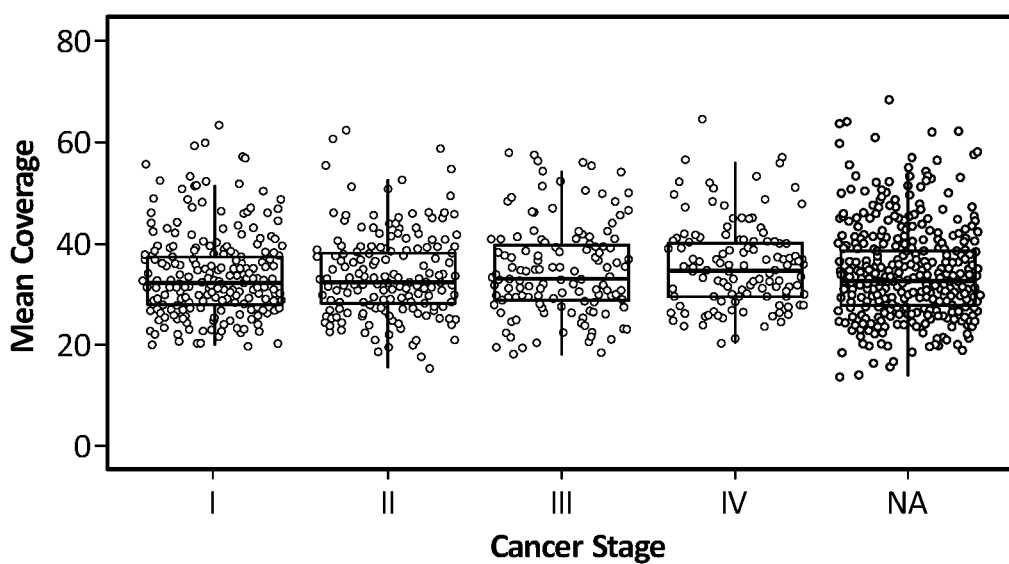
Figure 9C:
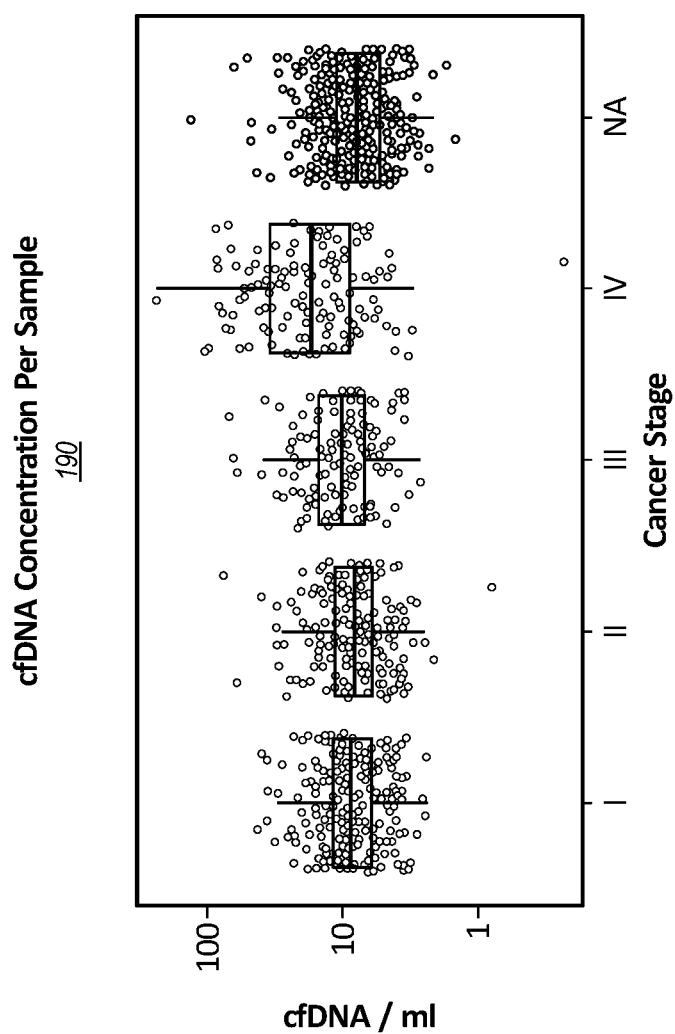

FIG. 9A (Conversion Accuracy), FIG. 9B (Sequencing Depth), and FIG. 9C (cfDNA Concentration Per Sample) show graphs of data validating the consistency of sequencing from a control group.

Figure 10:
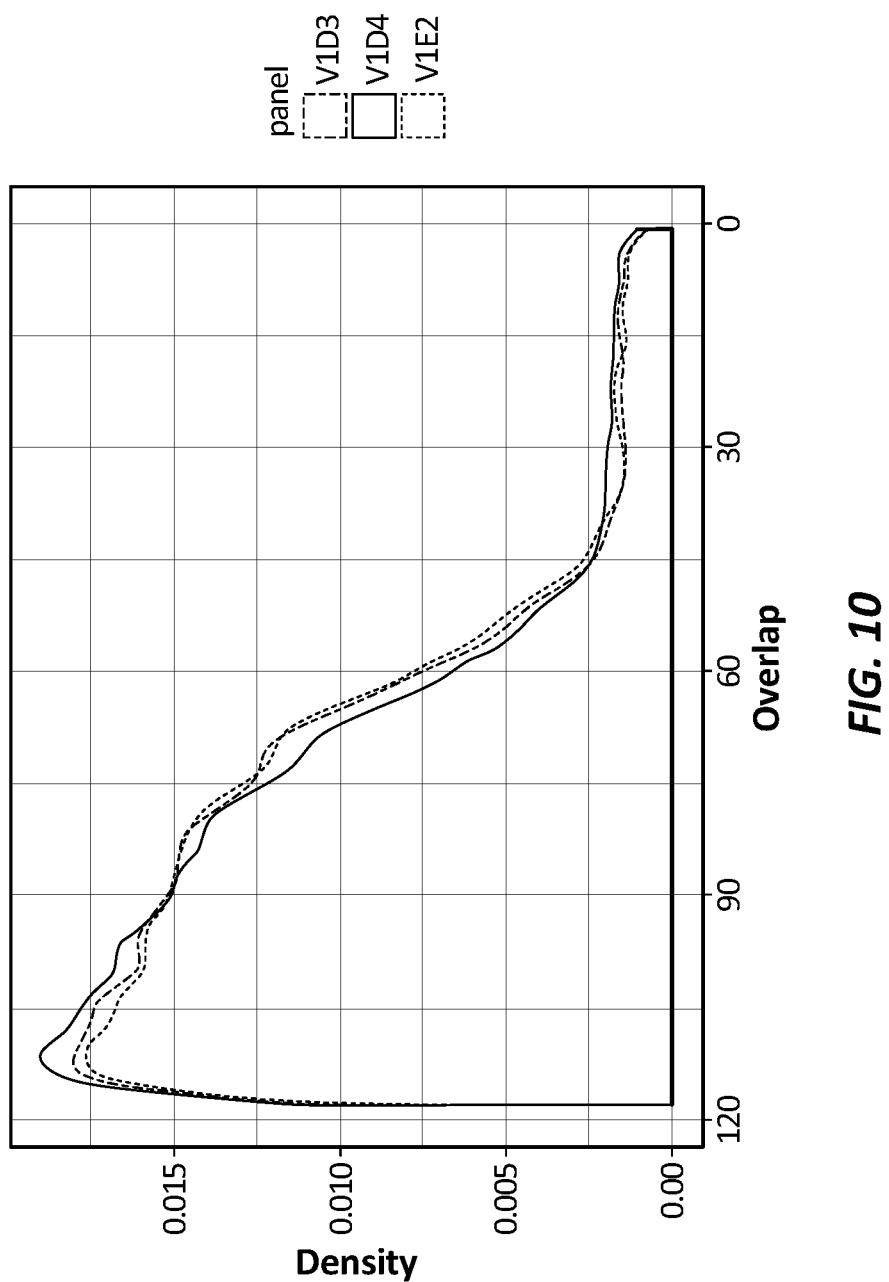

FIG. 10 is a graph of the amounts of DNA fragments binding to probes depending on the sizes of overlaps between the DNA fragments and the probes.

Figure 11:
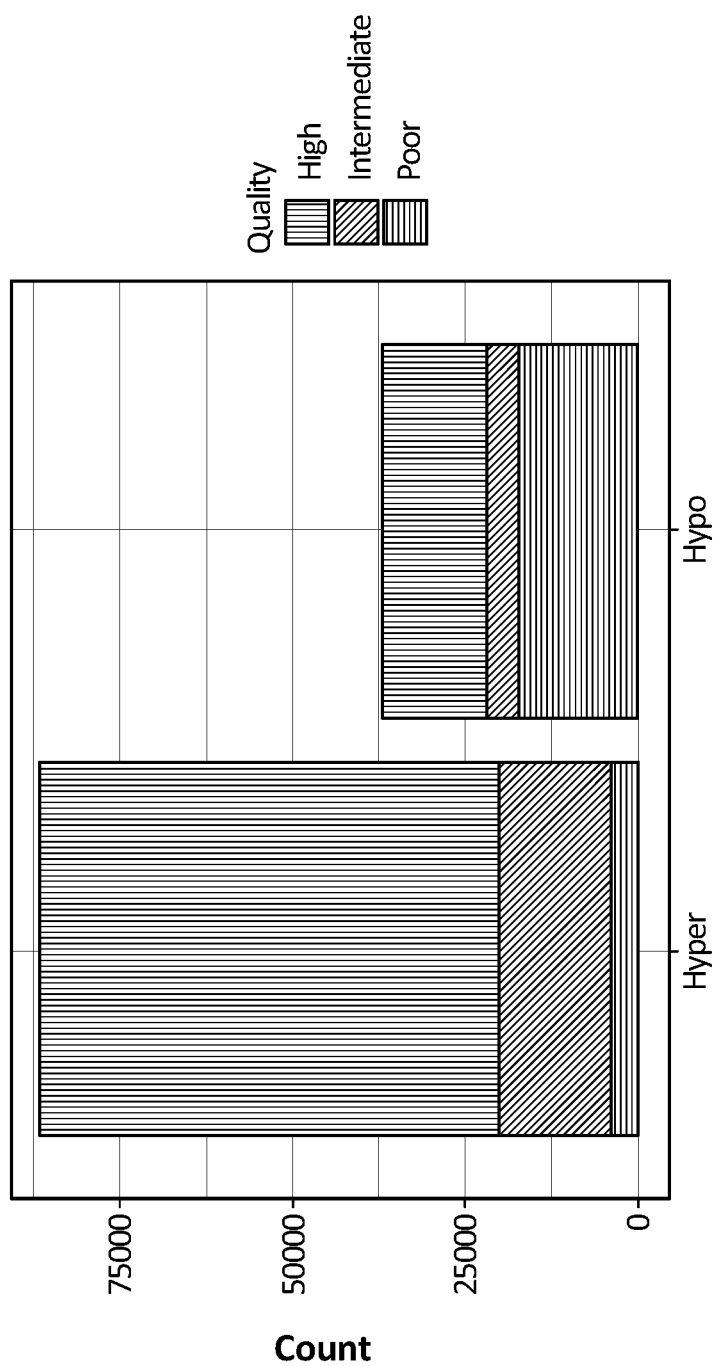

FIG. 11 compares the numbers of high quality, intermediate quality, and poor quality probes among the probes targeting hypermethylated fragments (Hyper) or hypomethylated fragments (Hypo).

Figure 12B:
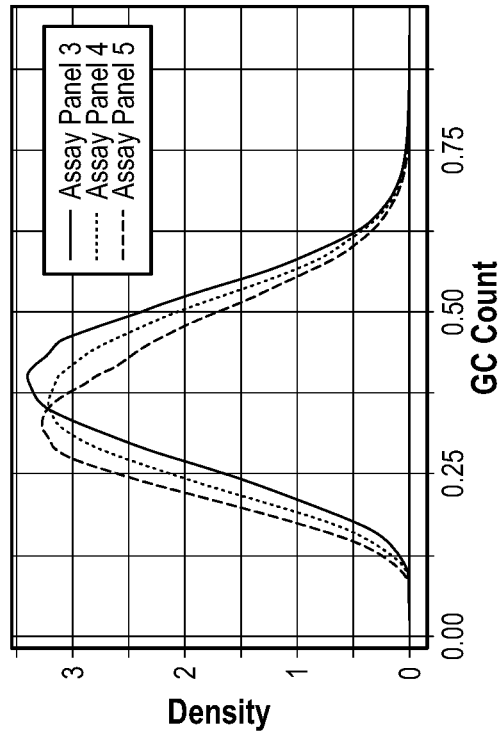
Figure 12A:
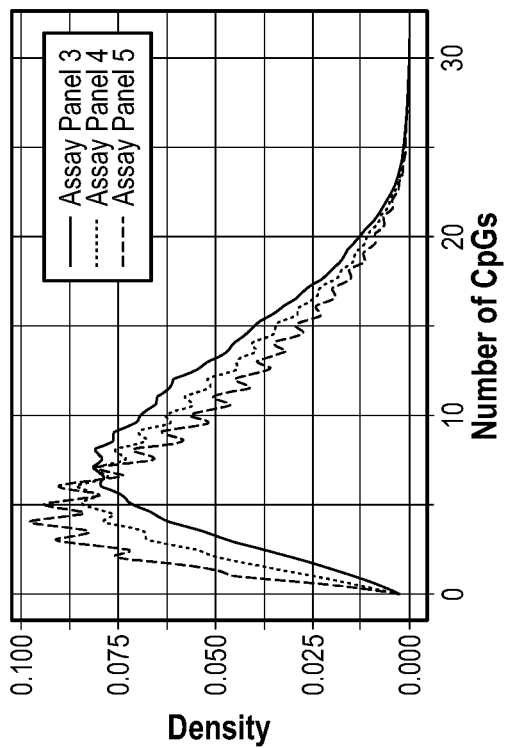

FIG. 12A shows the number, for various assay panels, the number of CpGs as a function of density.

FIG. 12B shows, for various assay panels, the G/C fraction as a function of density.

FIG. 13A (Assay Panel 3), FIG. 13B (Assay Panel 4) and FIG. 13C (Assay Panel 5) summarize frequencies of genomic annotations of targeted genomic regions (black) and randomly selected regions (white) in the indicated Assay Panels.

Figures 14A, 14B:
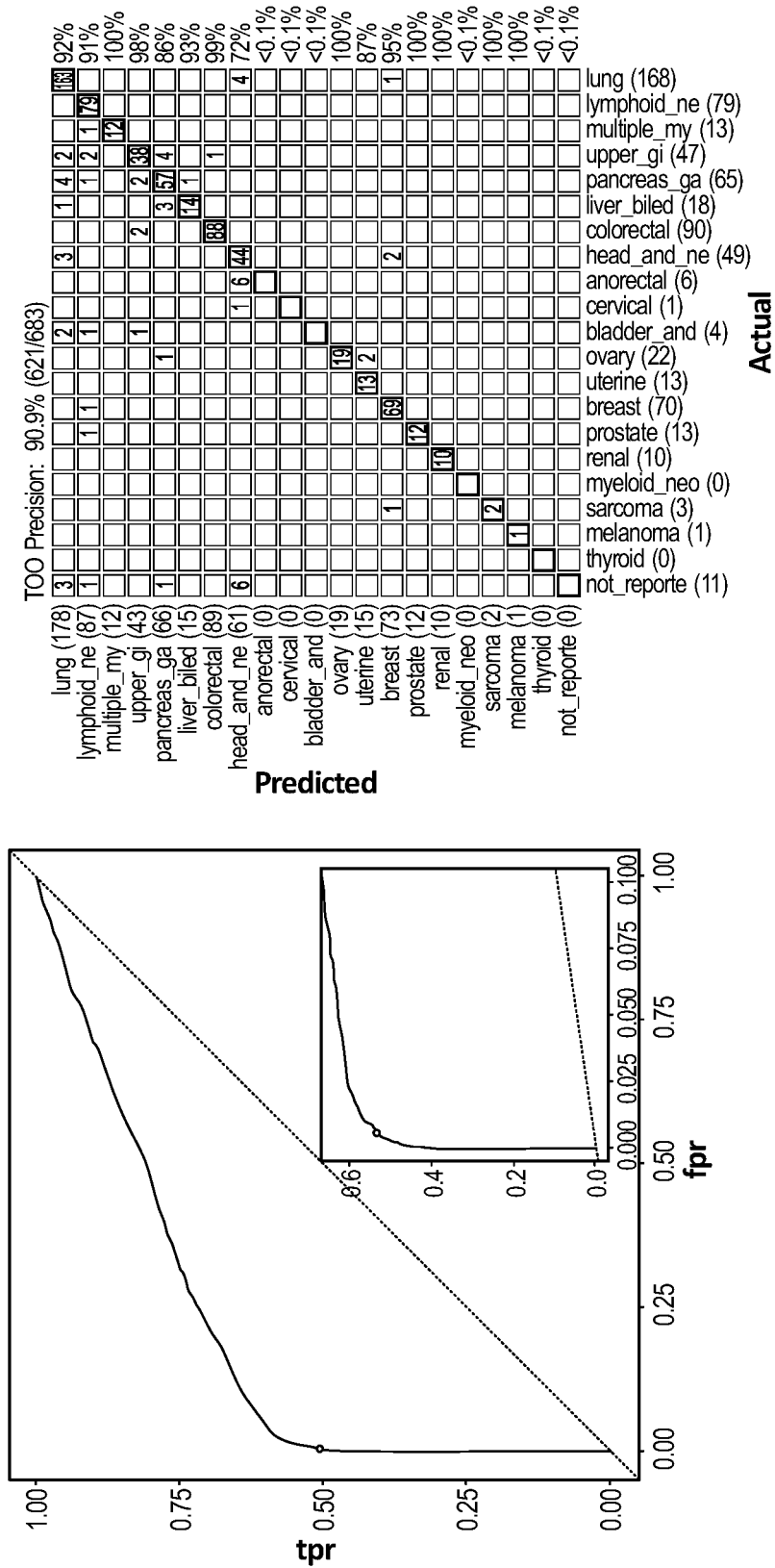

FIG. 14A depicts a receiver operator curve (ROC) showing the sensitivity and specificity of cancer detection using Assay Panel 1.

FIG. 14B is a confusion matrix depicting the accuracy of tissue of origin (TOO) classifications using Assay Panel 1.

Figures 15A, 15B:
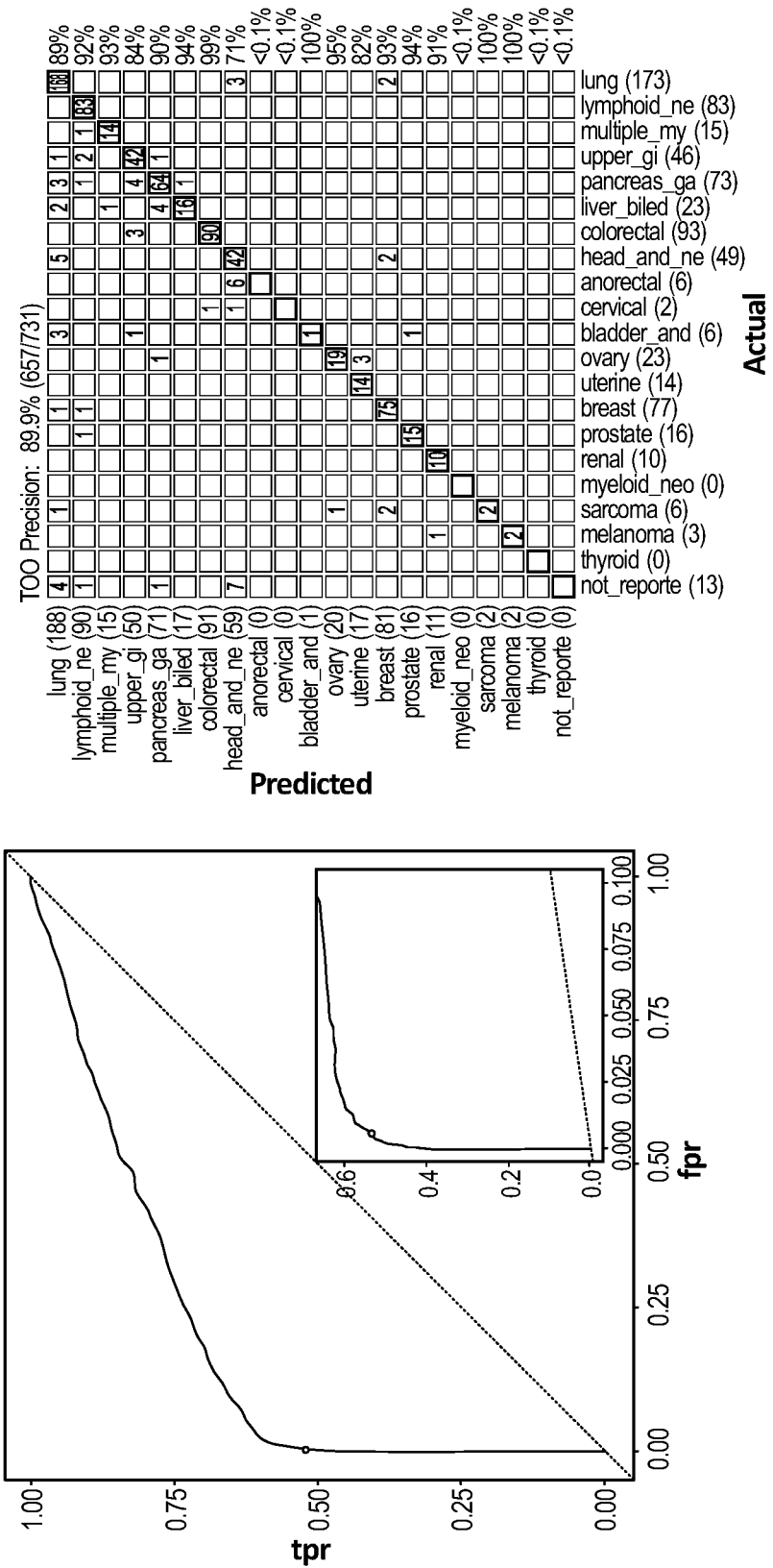

FIG. 15A depicts a receiver operator curve (ROC) showing the sensitivity and specificity of cancer detection using Assay Panel 2.

FIG. 15B is a confusion matrix depicting the accuracy of tissue of origin (TOO) classifications using Assay Panel 2.

Figures 16A, 16B:
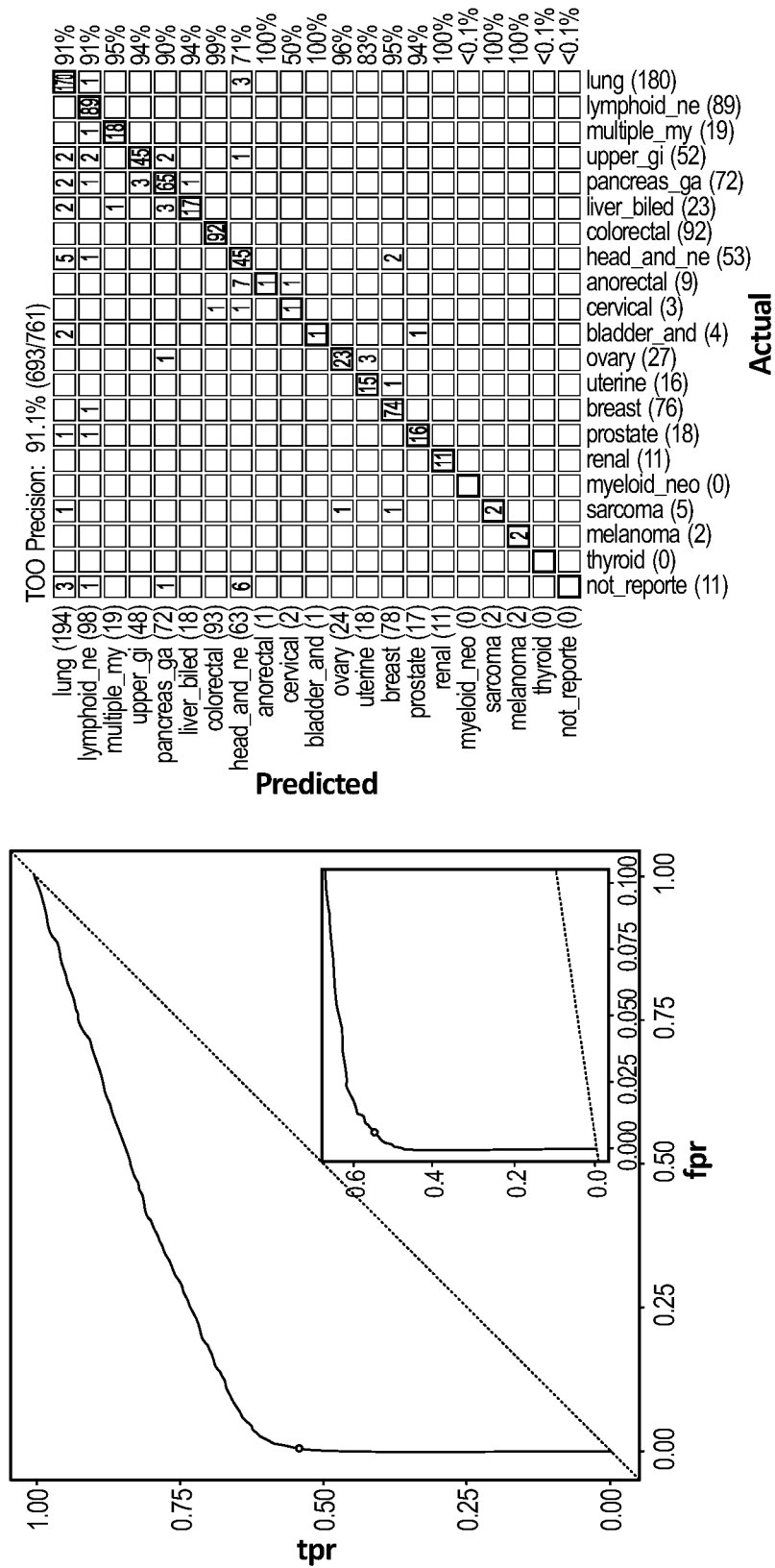

FIG. 16A depicts a receiver operator curve (ROC) showing the sensitivity and specificity of cancer detection using Assay Panel 3.

FIG. 16B is a confusion matrix depicting the accuracy of tissue of origin (TOO) classifications using Assay Panel 3.

Figures 17A, 17B:
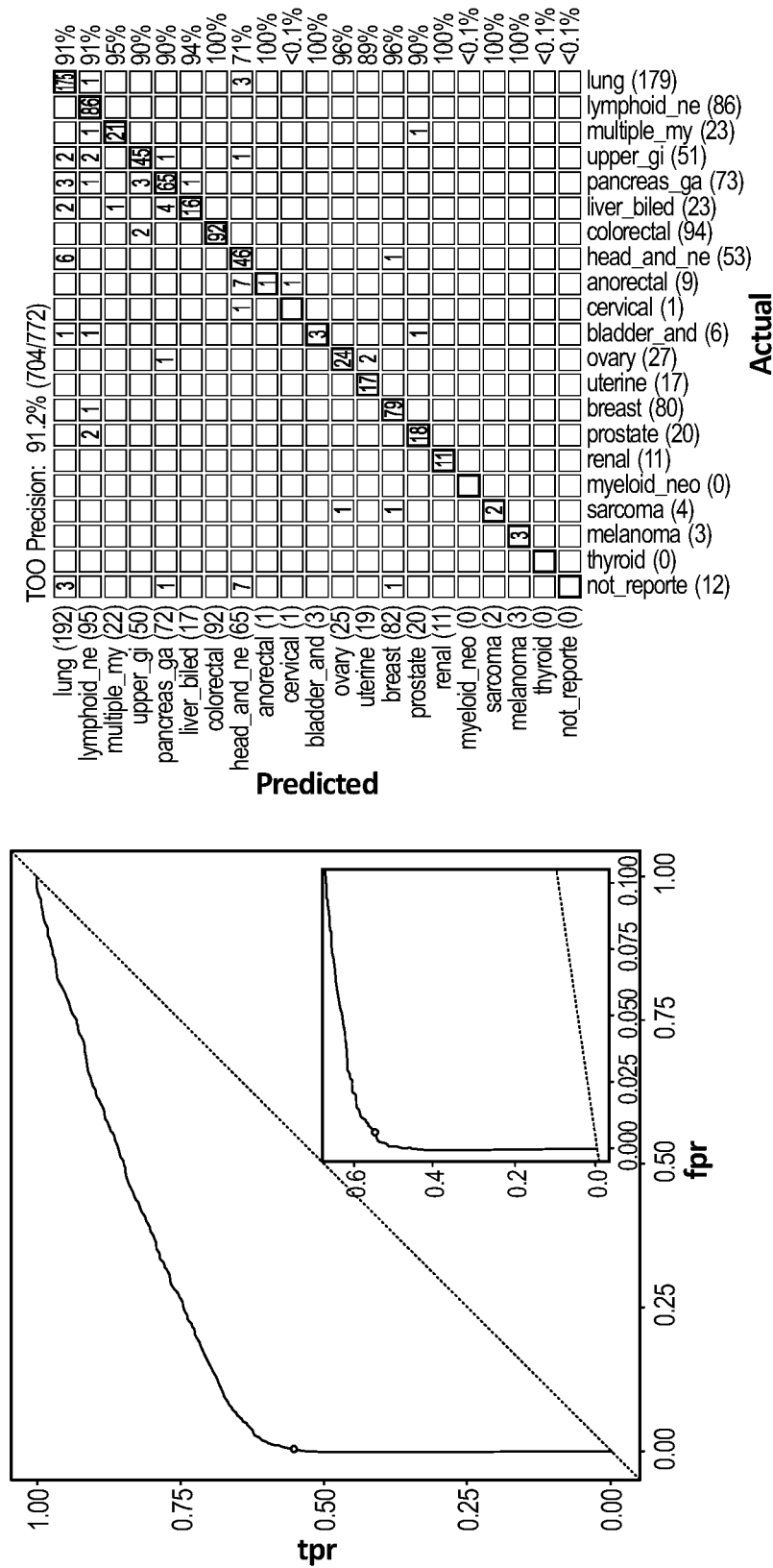

FIG. 17A depicts a receiver operator curve (ROC) showing the sensitivity and specificity of cancer detection using Assay Panel 4.

FIG. 17B is a confusion matrix depicting the accuracy of tissue of origin (TOO) classifications using Assay Panel 4.

Figures 18A, 18B:
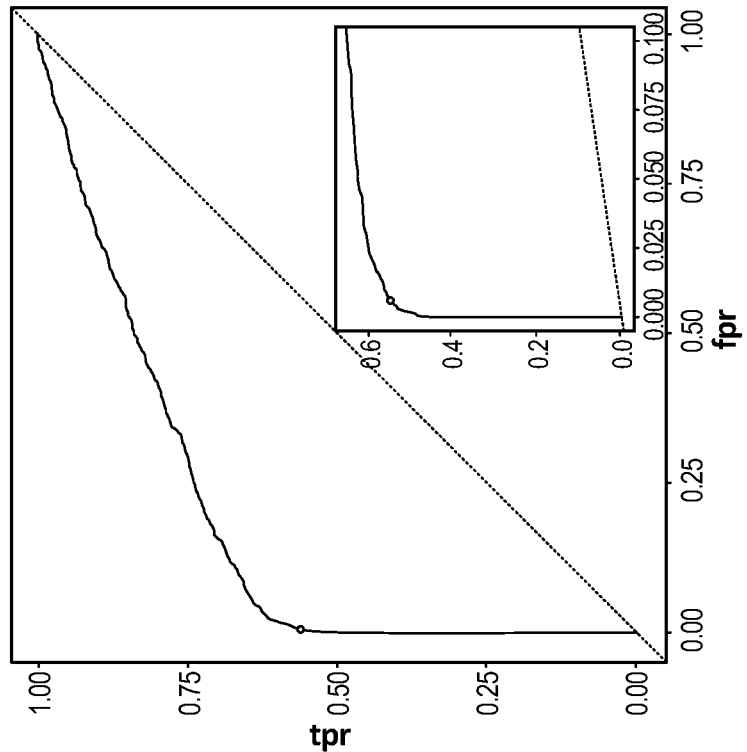

FIG. 18A depicts a receiver operator curve (ROC) showing the sensitivity and specificity of cancer detection using Assay Panel 5.

FIG. 18B is a confusion matrix depicting the accuracy of tissue of origin (TOO) classifications using Assay Panel 5.

FIG. 19A depicts a receiver operator curve (ROC) showing the sensitivity and specificity of cancer detection using Assay Panel 6.

FIG. 19B is a confusion matrix depicting the accuracy of tissue of origin (TOO) classifications using Assay Panel 6.

Figures 20A, 20B:
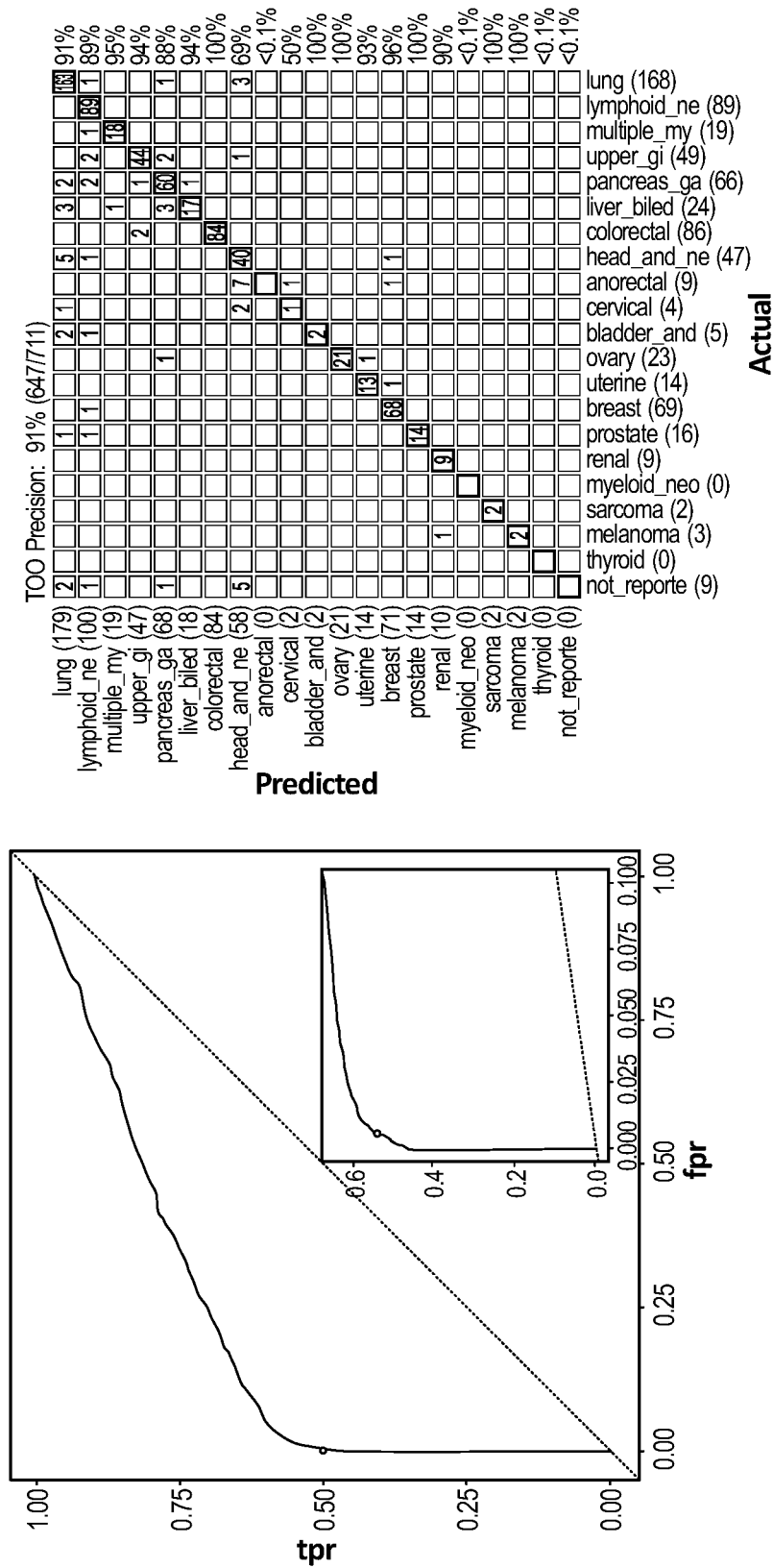

FIG. 20A depicts a receiver operator curve (ROC) showing the sensitivity and specificity of cancer detection using Assay Panel 3A.

FIG. 20B is a confusion matrix depicting the accuracy of tissue of origin (TOO) classifications using Assay Panel 3A.

Figures 21A, 21B:
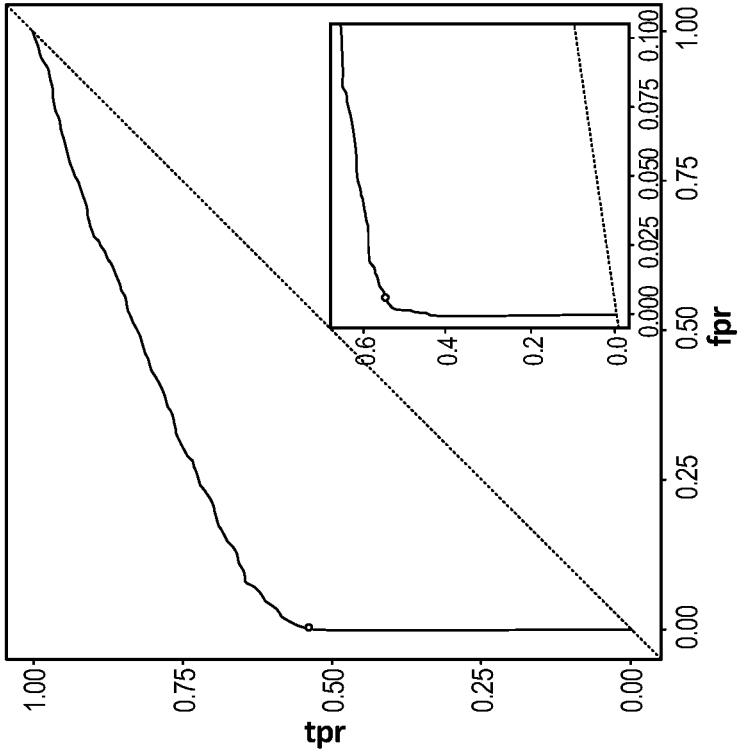

FIG. 21A depicts a receiver operator curve (ROC) showing the sensitivity and specificity of cancer detection using Assay Panel 4A.

FIG. 21B is a confusion matrix depicting the accuracy of tissue of origin (TOO) classifications using Assay Panel 4A.

Figures 22A, 22B:
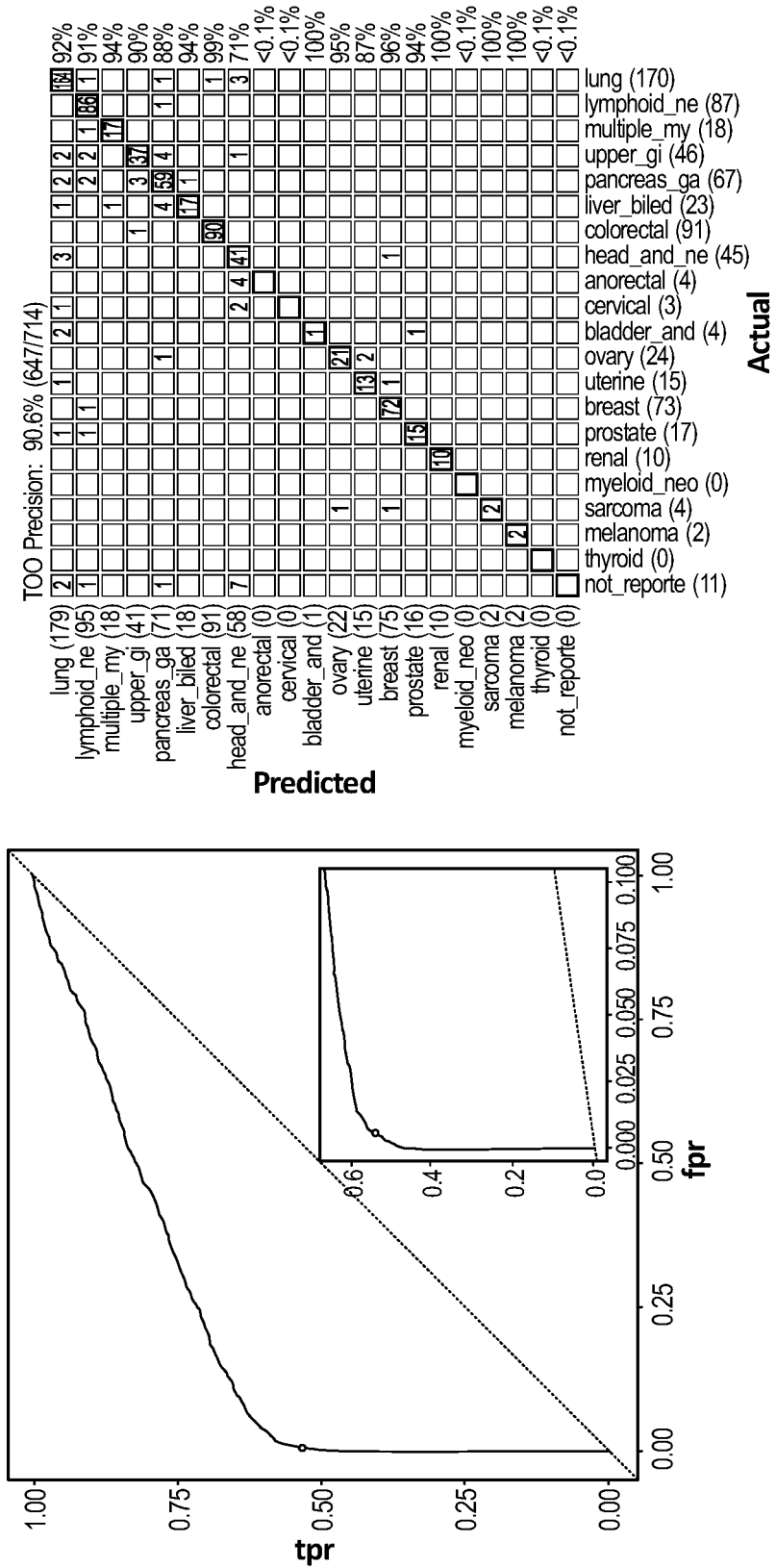

FIG. 22A depicts a receiver operator curve (ROC) showing the sensitivity and specificity of cancer detection using a random selection (subset a) of 40% of the targeted genomic regions in Assay Panel 3.

FIG. 22B is a confusion matrix depicting the accuracy of tissue of origin (TOO) classifications using a random selection (subset a) of 40% of the targeted genomic regions in Assay Panel 3.

Figures 23A, 23B:
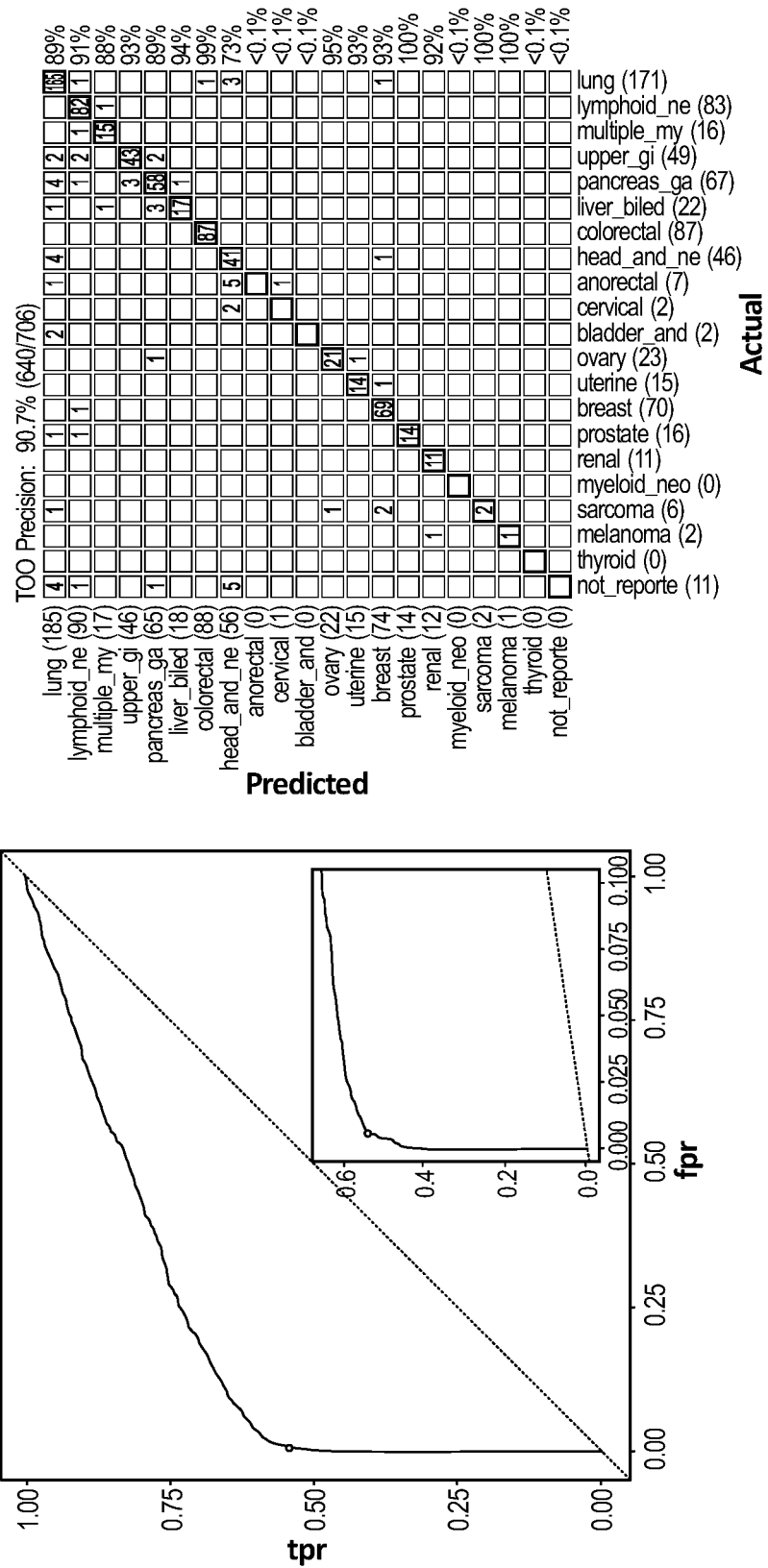

FIG. 23A depicts a receiver operator curve (ROC) showing the sensitivity and specificity of cancer detection using a random selection (subset b) of 40% of the targeted genomic regions in Assay Panel 3.

FIG. 23B is a confusion matrix depicting the accuracy of tissue of origin (TOO) classifications using a random selection (subset b) of 40% of the targeted genomic regions in Assay Panel 3.

Figures 24A, 24B:
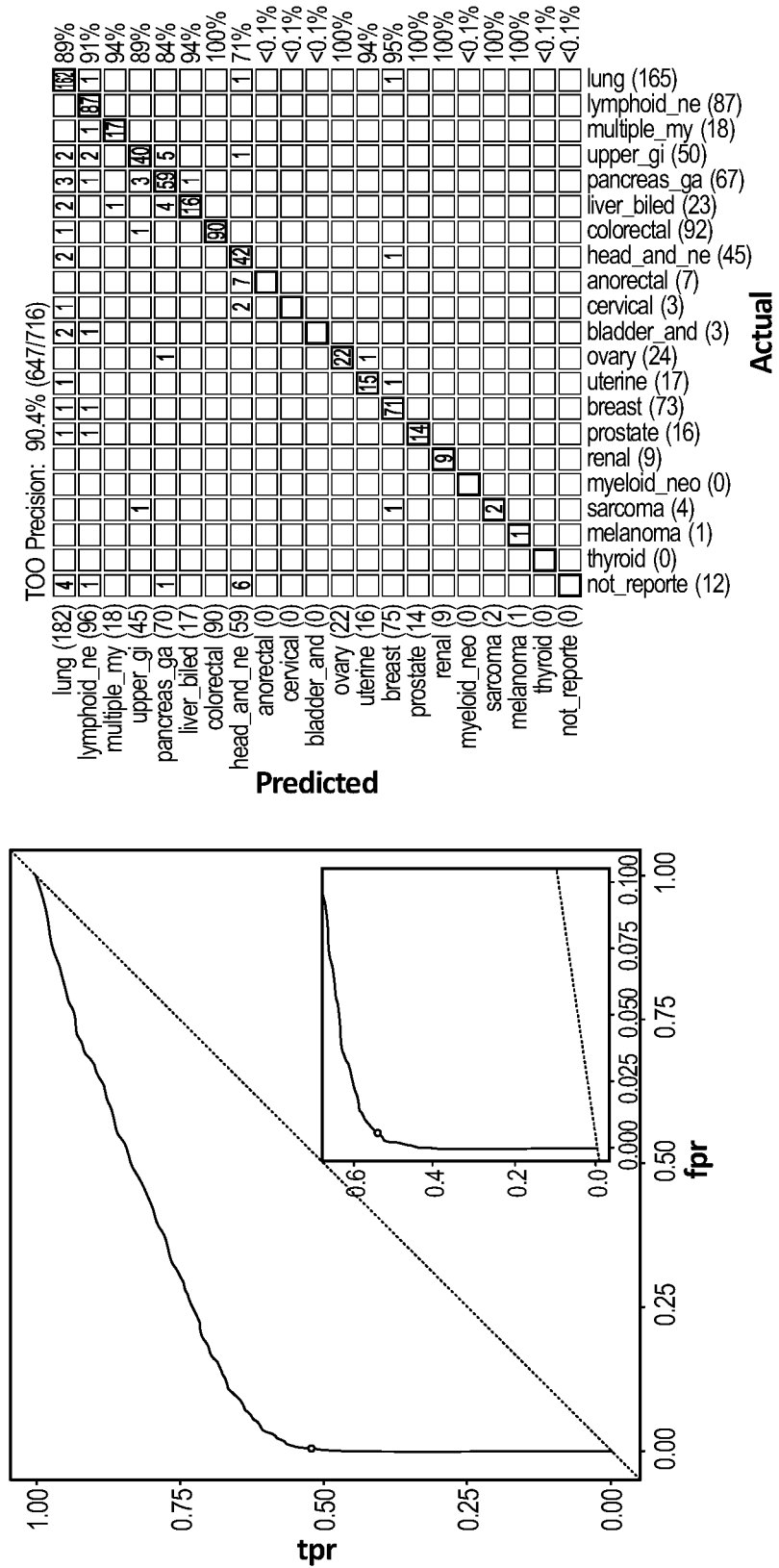

FIG. 24A depicts a receiver operator curve (ROC) showing the sensitivity and specificity of cancer detection using a random selection (subset c) of 40% of the targeted genomic regions in Assay Panel 3.

FIG. 24B is a confusion matrix depicting the accuracy of tissue of origin (TOO) classifications using a random selection (subset c) of 40% of the targeted genomic regions in Assay Panel 3.

Figures 25A, 25B:
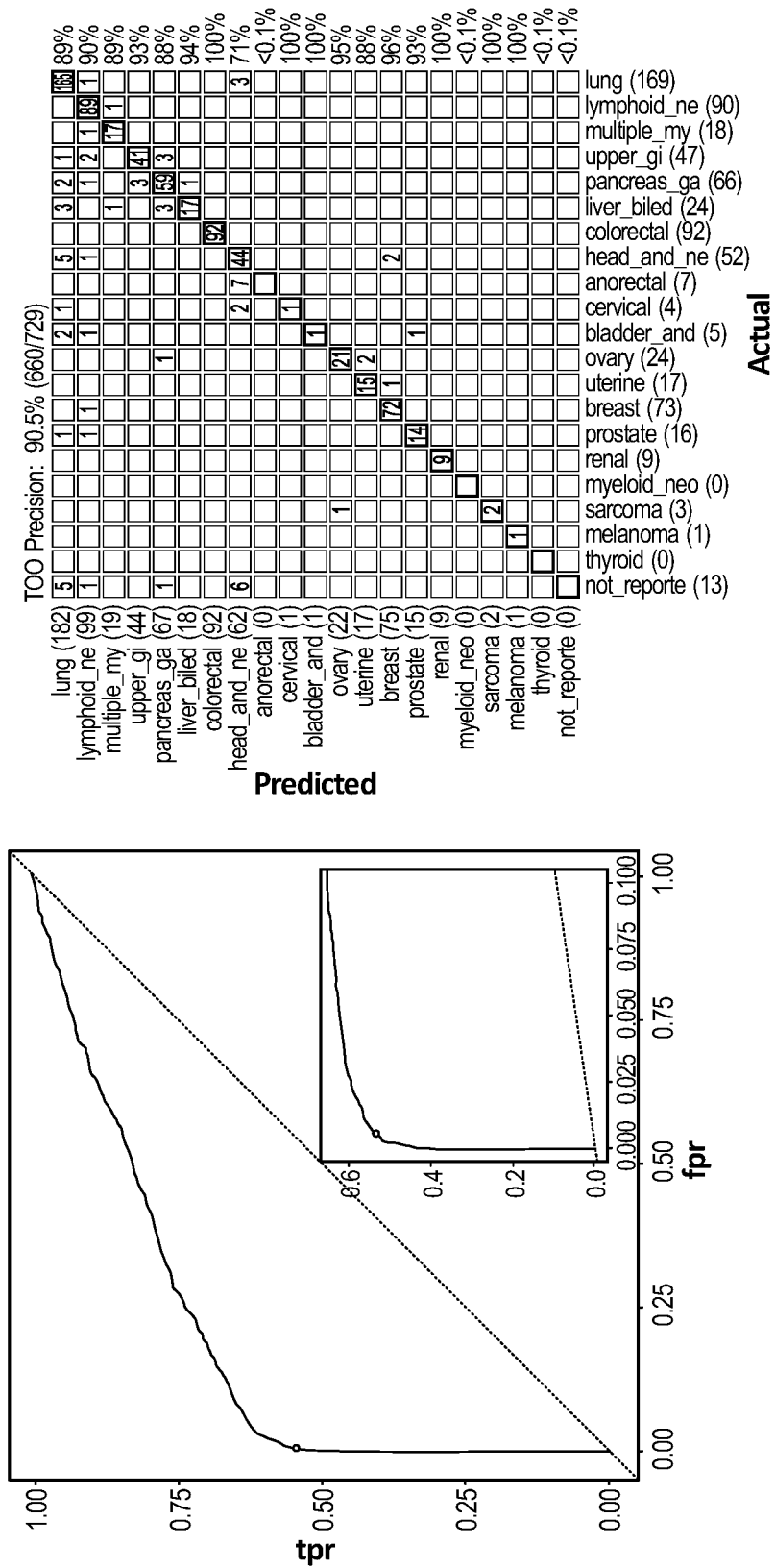

FIG. 25A depicts a receiver operator curve (ROC) showing the sensitivity and specificity of cancer detection using a random selection of 60% of the targeted genomic regions in Assay Panel 3.

FIG. 25B is a confusion matrix depicting the accuracy of tissue of origin (TOO) classifications using a random selection of 60% of the targeted genomic regions in Assay Panel 3.

Figures 26A, 26B:
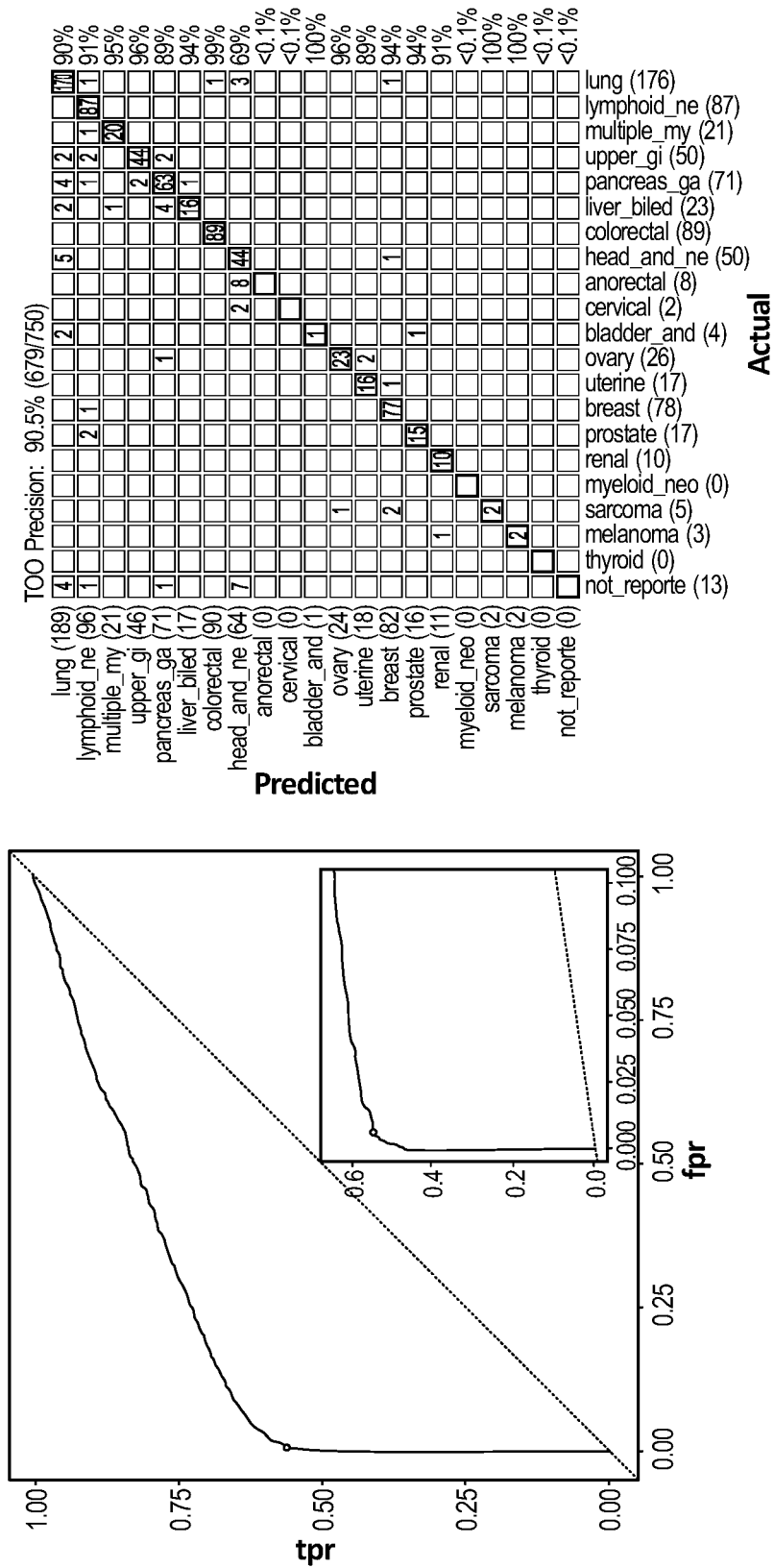

FIG. 26A depicts a receiver operator curve (ROC) showing the sensitivity and specificity of cancer detection using a random selection of 50% of the targeted genomic regions in Assay Panel 4.

FIG. 26B is a confusion matrix depicting the accuracy of tissue of origin (TOO) classifications using a random selection of 50% of the targeted genomic regions in Assay Panel 4.

Figures 27A, 27B:
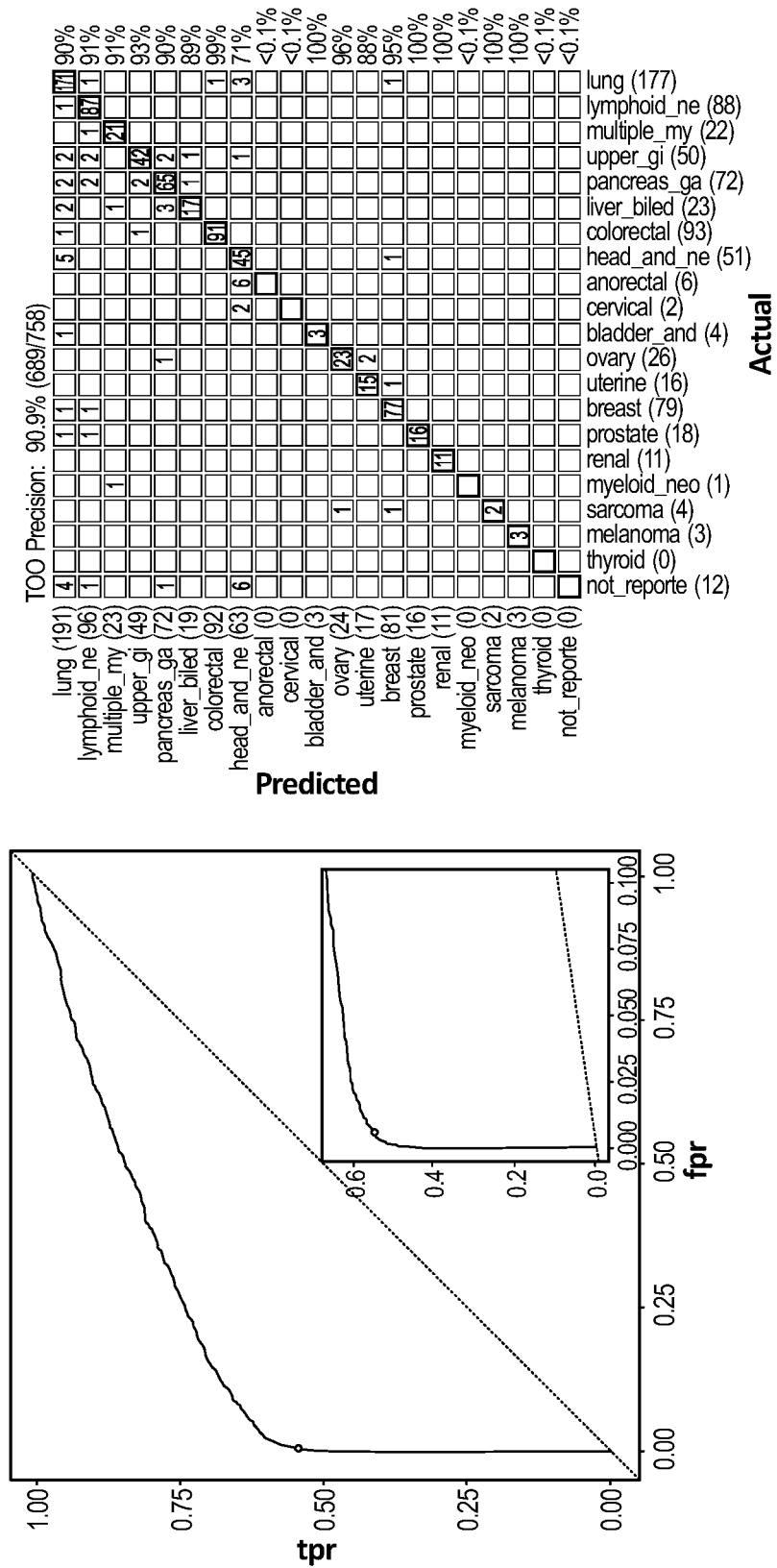

FIG. 27A depicts a receiver operator curve (ROC) showing the sensitivity and specificity of cancer detection using a random selection of 50% of the targeted genomic regions in Assay Panel 5.

FIG. 27B is a confusion matrix depicting the accuracy of tissue of origin (TOO) classifications using a random selection of 50% of the targeted genomic regions in Assay Panel 5.

The figures depict various embodiments of the present description for purposes of illustration only. One skilled in the art will readily recognize from the following discussion that alternative embodiments of the structures and methods illustrated herein may be employed without departing from the principles of the description described herein.

6. DETAILED DESCRIPTION

6.1. Definitions

Unless defined otherwise, all technical and scientific terms used herein have the meaning commonly understood by a person skilled in the art to which this description belongs. As used herein, the following terms have the meanings ascribed to them below.

The term "methylation" as used herein refers to a process by which a methyl group is added to a DNA molecule. For example, a hydrogen atom on the pyrimidine ring of a cytosine base can be converted to a methyl group, forming 5-methylcytosine. The term also refers to a process by which a hydroxymethyl group is added to a DNA molecules, for example by oxidation of a methyl group on the pyrimidine ring of a cytosine base. Methylation and hydroxymethylation tend to occur at dinucleotides of cytosine and guanine referred to herein as "CpG sites.

In such embodiments, the wet laboratory assay used to detect methylation may vary from those described herein as is well known in the art.

The term "methylation site" as used herein refers to a region of a DNA molecule where a methyl group can be added. "CpG" sites are the most common methylation site, but methylation sites are not limited to CpG sites. For example, DNA methylation may occur in cytosines in CHG and CHH, where H is adenine, cytosine or thymine. Cytosine methylation in the form of 5-hydroxymethylcytosine may also assessed (see, e.g., WO 2010/037001 and WO 2011/127136, which are incorporated herein by reference), and features thereof, using the methods and procedures disclosed herein.

The term "CpG site" as used herein refers to a region of a DNA molecule where a cytosine nucleotide is followed by a guanine nucleotide in the linear sequence of bases along its 5' to 3' direction. "CpG" is a shorthand for 5'-C-phosphate-G-3' that is cytosine and guanine separated by only one phosphate group. Cytosines in CpG dinucleotides can be methylated to form 5-methylcytosine.

The term "CpG detection site" as used herein refers to a region in a probe that is configured to hybridize to a CpG site of a target DNA molecule. The CpG site on the target DNA molecule can comprise cytosine and guanine separated by one phosphate group, where cytosine is methylated or unmethylated. The CpG site on the target DNA molecule can comprise uracil and guanine separated by one phosphate group, where the uracil is generated by the conversion of unmethylated cytosine.

The term "UpG" is a shorthand for 5'-U-phosphate-G-3' that is uracil and guanine separated by only one phosphate group. UpG can be generated by a bisulfite treatment of a DNA that converts unmethylated cytosines to uracils. Cytosines can be converted to uracils by other methods known in the art, such as chemical modification, synthesis, or enzymatic conversion.

The term "hypomethylated" or "hypermethylated" as used herein refers to a methylation status of a DNA molecule containing multiple CpG sites (e.g., more than 3, 4, 5, 6, 7, 8, 9, 10, etc.) where a high percentage of the CpG sites (e.g., more than 80%, 85%, 90%, or 95%, or any other percentage within the range of 50%-100%) are unmethylated or methylated, respectively.

The terms "methylation state vector" or "methylation status vector" as used herein refers to a vector comprising multiple elements, where each element indicates the methylation status of a methylation site in a DNA molecule comprising multiple methylation sites, in the order they appear from 5' to 3' in the DNA molecule. For example, $<M_x, M_{x+1}, M_{x+2}>$, $<M_x, M_{x+1}, U_{x+2}>$, ..., $<U_x, U_{x+1}, U_{x+2}>$ can be methylation vectors for DNA molecules comprising three methylation sites, where M represents a methylated methylation site and U represents an unmethylated methylation site.

The term "abnormal methylation pattern" or "anomalous methylation pattern" as used herein refers to the methylation pattern of a DNA molecule or a methylation state vector that is expected to be found in a sample less frequently than a threshold value. In a particular embodiment provided herein, the expectedness of finding a specific methylation state vector in a healthy control group comprising healthy individuals (e.g. individuals who have not been diagnosed with cancer) is represented by a p-value. A low p-value score generally corresponds to a methylation state vector which is relatively unexpected in comparison to other methylation state vectors within samples from healthy individuals. A high p-value score generally corresponds to a methylation state vector which is relatively more expected in comparison to other methylation state vectors found in samples from healthy individuals in the healthy control group. A methylation state vector having a p-value lower than a threshold value (e.g., 0.1, 0.01, 0.001, 0.0001, etc.) can be defined as an abnormal/anomalous methylation pattern. Various methods known in the art can be used to calculate a p-value or expectedness of a methylation pattern or a methylation state vector. Exemplary methods provided herein involve use of a Markov chain probability that assumes methylation statuses of CpG sites to be dependent on methylation statuses of neighboring CpG sites. Alternate methods provided herein calculate the expectedness of observing a specific methylation state vector in healthy individuals by utilizing a mixture model including multiple mixture components, each being an independent-sites model where methylation at each CpG site is assumed to be independent of methylation statuses at other CpG sites.

Methods provided herein characterize DNA fragments as anomalous when they have a methylation pattern that is unusual in comparison to the methylation patterns of DNA fragments in reference samples, such as samples from individuals who have not been diagnosed with cancer. The likelihood of a particular methylation pattern being observed in reference samples can be represented as a p-value score. Exemplary methods provided herein for modeling the likelihood of a particular methylation pattern involve use of a Markov chain probability and a sliding window. If the p-value score falls below a threshold (e.g., 0.1, 0.01, 0.001, 0.0001, etc.), the DNA fragment having that methylation pattern is classified as being anomalous. Multiple p-value scores corresponding to hypermethylated or hypomethylated DNA fragments can be summed or averaged before being compared to the threshold value. Various methods known in the art can be adopted to compare p-value scores corresponding to the genomic region and the threshold value, including but not limited to arithmetic mean, geometric mean, harmonic mean, median, mode, etc.

The term "cancerous sample" as used herein refers to a sample comprising genomic DNAs from an individual diagnosed with cancer. The genomic DNAs can be, but are not limited to, cfDNA fragments or chromosomal DNAs from a subject with cancer. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual diagnosed with cancer, cancerous sample can refer to genomic DNAs or cfDNA fragments having the genomic sequences. The term "cancerous samples" as a plural refers to samples comprising genomic DNAs from multiple individuals, each individual diagnosed with cancer. In various embodiments, cancerous samples from more than 100, 300, 500, 1,000, 10,000, 20,000, 40,000, 50,000, or more individuals diagnosed with cancer are used.

The term "non-cancerous sample" as used herein refers to a sample comprising genomic DNAs from an individual not diagnosed with cancer. The genomic DNAs can be, but are not limited to, cfDNA fragments or chromosomal DNAs from a subject without cancer. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual without cancer, non-cancerous sample can refer to genomic DNAs or cfDNA fragments having the genomic sequences. The term "non-cancerous samples" as a plural refers to samples comprising genomic DNAs from multiple individuals, each individual is not diagnosed with cancer. In various embodiments, cancerous samples from more than 100, 300, 500, 1,000, 10,000, 20,000, 40,000, 50,000, or more individuals without cancer are used.

The term "training sample" as used herein refers to a sample used to train a classifier described herein and/or to select one or more genomic regions for cancer diagnosis. The training samples can comprise genomic DNAs or a modification there of, from one or more healthy subjects and from one or more subjects having a disease condition for diagnosis (e.g., cancer, a specific type of cancer, a specific stage of cancer, etc.). The genomic DNAs can be, but are not limited to, cfDNA fragments or chromosomal DNAs. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual, a training sample can refer to genomic DNAs or cfDNA fragments having the genomic sequences.

The term "test sample" as used herein refers to a sample from a subject, whose health condition was, has been or will be tested using a classifier and/or an assay panel described herein. The test sample can comprise genomic DNAs or a modification there of. The genomic DNAs can be, but are not limited to, cfDNA fragments or chromosomal DNAs.

The term "target genomic region" as used herein refers to a region in a genome selected for selected for analysis in test samples. An assay panel is generated with probes designed to hybridize to (and optionally pull down) nucleic acid fragments derived from the target genomic region or a fragment thereof. A nucleic acid fragment derived from the target genomic region refers to a nucleic acid fragment generated by degradation, cleavage, bisulfite conversion, or other processing of the DNA from the target genomic region.

The term "off-target genomic region" as used herein refers to a region in a genome which has not been selected for analysis in test samples, but has sufficient homology to a target genomic region to potentially be bound and pulled down by a probe designed to target the target genomic region. In one embodiment, an off-target genomic region is a genomic region that aligns to a probe along at least 45 bp with at least a 90% match rate.

The terms "converted DNA molecules," "converted cfDNA molecules," and "modified fragment obtained from processing of the cfDNA molecules" refer to DNA molecules obtained by processing DNA or cfDNA molecules in a sample for the purpose of differentiating a methylated nucleotide and an unmethylated nucleotide in the DNA or cfDNA molecules. For example, in one embodiment, the sample can be treated with bisulfite ion (e.g., using sodium bisulfite), as is well-known in the art, to convert unmethylated cytosines ("C") to uracils ("U"). In another embodiment, the conversion of unmethylated cytosines to uracils is accomplished using an enzymatic conversion reaction, for example, using a cytidine deaminase (such as APOBEC). After treatment, converted DNA molecules or cfDNA molecules include additional uracils which are not present in the original cfDNA sample. Replication by DNA polymerase of a DNA strand comprising a uracil results in addition of an adenine to the nascent complementary strand instead of the guanine normally added as the complement to a cytosine or methylcytosine.

The term "cell free nucleic acid," "cell free DNA," or "cfDNA" refers to nucleic acid fragments that circulate in an individual's body (e.g., bloodstream) and originate from one or more healthy cells and/or from one or more cancerous cells. Additionally, cfDNA may come from other sources such as viruses, fetuses, etc.

The term "circulating tumor DNA" or "ctDNA" refers to nucleic acid fragments that originate from tumor cells, which may be released into an individual's bloodstream as result of biological processes such as apoptosis or necrosis of dying cells or actively released by viable tumor cells.

The term "fragment" as used herein can refer to a fragment of a nucleic acid molecule. For example, in one embodiment, a fragment can refer to a cfDNA molecule in a blood or plasma sample, or a cfDNA molecule that has been extracted from a blood or plasma sample. An amplification product of a cfDNA molecule may also be referred to as a "fragment." In another embodiment, the term "fragment" refers to a sequence read, or set of sequence reads, that have been processed for subsequent analysis (e.g., for in machine-learning based classification), as described herein. For example, as is well known in the art, raw sequence reads can be aligned to a reference genome and matching paired end sequence reads assembled into a longer fragment for subsequent analysis.

The term "individual" refers to a human individual. The term "healthy individual" refers to an individual presumed not to have a cancer or disease.

The term "subject" refers to an individual whose DNA is being analyzed. A subject may be a test subject whose DNA is be evaluated using a targeted panel as described herein to evaluate whether or not the person has cancer or another disease. A subject may also be part of a control group known not to have cancer or another disease. A subject may also be part of a cancer or other disease group known to have cancer or another disease. Control and cancer/disease groups may be used to assist in designing or validating the targeted panel.

The term "sequence reads" as used herein refers to nucleotide sequences reads from a sample. Sequence reads can be obtained through various methods provided herein or as known in the art.

The term "sequencing depth" as used herein refers to the count of the number of times a given target nucleic acid within a sample has been sequenced (e.g., the count of sequence reads at a given target region). Increasing sequencing depth can reduce required amounts of nucleic acids required to assess a disease state (e.g., cancer or cancer tissue of origin).

The term "tissue of origin" or "TOO" as used herein refers to the organ, organ group, body region or cell type that cancer arises or originates from. The identification of a tissue of origin or cancer cell type typically allows for identification of the most appropriate next steps in the care continuum of cancer to further diagnose, stage, and decide on treatment.

The term "transition" generally refers to changes in base composition from one purine to another purine, or from one pyrimidine to another pyrimidine. For instance, the following changes are transitions: C→U, U→C, G→A, A→G, C→T, and T→C.

"An entirety of probes" of a panel or bait set or "an entirety of polynucleotide-containing probes" of a panel or bait set generally refers to all of the probes delivered with a specified panel or bait set. For instance, in some embodiments, a panel or bait set may include both (1) probes having features specified herein (e.g., probes for binding to cell-free DNA fragments corresponding to or derived from genomic regions set forth herein in one or more Lists) and (2) additional probes that do not contain such feature(s). The entirety of probes of a panel generally refers to all probes delivered with the panel or bait set, including such probes that do not contain the specified feature(s).

6.2. Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

6.3. Cancer Assay Panel

In a first aspect, the present description provides a cancer assay panel (e.g., a bait set) comprising a plurality of probes. The probes can be polynucleotide-containing probes that are specifically designed to target one or more nucleic acid molecules corresponding to or derived from genomic regions that are differentially methylated in cancer compared to non-cancer samples as identified by methods provided herein. The probes are used as baits to collect cfDNA derived from target genomic regions that are differentially methylated in cancer. In a diagnostic assay, enrichment increases sensitivity and accuracy while reducing sequencing expenses.

For designing the cancer assay panel, an analytics system may collect samples corresponding to various outcomes under consideration, e.g., samples known to have cancer, samples considered to be healthy, samples from a known tissue of origin, etc. The sources of the cfDNA and/or ctDNA used to select target genomic regions can vary depending on the purpose of the assay. For example, different sources may be desirable for an assay intended to diagnose cancer generally, a specific type of cancer, a cancer stage, or a tissue of origin. These samples may be processed with whole-genome bisulfite sequencing (WGBS) or obtained from public database (e.g., TCGA). The analytics system may be any generic computing system with a computer processor and a computer-readable storage medium with instructions for executing the computer processor to perform any or all operations described in this present disclosure.

The analytics system may then select target genomic regions based on methylation patterns of nucleic acid fragments. One approach considers pairwise distinguishability between pairs of outcomes for regions or more specifically one or more CpG sites. Another approach considers distinguishability for regions or more specifically one or more CpG sites when considering each outcome against the remaining outcomes. From the selected target genomic regions with high distinguishability power, the analytics system may design probes to target nucleic acid fragments inclusive of the selected genomic regions. The analytics system may generate variable sizes of the cancer assay panel, e.g., where a small sized cancer assay panel includes probes targeting the most informative genomic region, a medium sized cancer assay panel includes probes from the small sized cancer assay panel and additional probes targeting a second tier of informative genomic regions, and a large sized cancer assay panel includes probes from the small sized and the medium sized cancer assay panels and even more probes targeting a third tier of informative genomic regions. With such cancer assay panels, the analytics system may train classifiers with various classification techniques to predict a sample's likelihood of having a particular outcome, e.g., cancer, specific cancer type, other disorder, etc.

Target genomic regions may be selected to maximize classification accuracy, subject to a size limitation (which is determined by sequencing budget and desired depth of sequencing). Potential target genomic regions can be ranked according to their tentative classification potential as described herein and then greedily added to a panel until the size limitation is reached.

A cancer assay panel can be used to detect the presence or absence of cancer generally, the stage (e.g., I, II, III or IV) of cancer, and/or the tissue of origin of a cancer. Depending on the purpose, a panel can include probes targeting genomic regions differentially methylated between general cancerous (pan-cancer) samples and non-cancerous samples. In some embodiments, a cancer assay panel is designed based on bisulfate sequencing data generated from the cfDNA and/or whole genomic DNA of a set of cancer and non-cancer individuals.

Each probe, probe pair, or probe set can be designed to target, by selective hybridization, one or more target genomic regions. The target genomic regions are selected based on several criteria designed to enhance selective enrichment of relevant cfDNA fragments while decreasing noise and non-specific binding. For example, a panel can include probes that can selectively hybridize to (i.e., bind to) and enrich cfDNA fragments that are differentially methylated in cancerous samples. Furthermore, the probes may be further designed to target genomic regions that are determined to have an anomalous methylation pattern comprising hypermethylation or hypomethylation. In some embodiments, a panel comprises both a first set of probes targeting hypermethylated fragments and a second set of probes targeting hypomethylated fragments. In some embodiments, the ratio between the first set of probes targeting hypermethylated fragments and the second set of probes targeting hypomethylated fragments (hyper:hypo ratio) ranges between 0.4 and 2, between 0.5 and 1.8, between 0.5 and 1.6, between 1.4 and 1.6, between 1.2 and 1.4, between 1 and 1.2, between 0.8 and 1, between 0.6 and 0.8 or between 0.4 and 0.6.

Sequencing of the enriched fragments provides information relevant to a diagnosis of cancer. Methods of identifying fragments having abnormal methylation patterns are provided in detail in Section 6.4.2 ("Anomalously methylated fragments") and methods of identifying fragments having hypomethylation or hypermethylation patterns are provided in detail in Section 6.4.3 ("Analysis of hyper or hypomethylated fragments").

For example, genomic regions can be selected when cfDNA and/or ctDNA fragments that align with a genomic region have a methylation pattern with a low p-value according to a Markov model trained on a set of non-cancerous samples. cfDNA and/or ctDNA fragments used to select genomic regions may additionally be required to contain at least a threshold number (e.g., 5) CpG's, and 70%, 75%, 80%, 85%, 90%, 95%, 98%, or 100% of the CPG sites may be required to be either methylated or unmethylated. Each of the probes can target at least 25 bp, 30 bp, 35 bp, 40 bp, 45 bp, 50 bp, 60 bp, 70 bp, 80 bp, 90 bp, 100 bp, 110 bp, or 120 bp of a genomic region. In some embodiments, the genomic regions is required to have less than 20, 15, 10, 8, or 6 methylation sites.

In some embodiments, target genomic region selection involves a calculation performed with respect to each CpG site. Specifically, a first count, $n_{cancer}$, is determined from the number of cancer-containing samples that include an abnormally hypermethylated and/or hypomethylated cfDNA and/or ctDNA fragment overlapping that CpG site, and a second count, $n_{non-cancer}$, is determined from the number of healthy samples that include an abnormally hypermethylated and/or hypomethylated cfDNA and/or ctDNA fragment overlapping that CpG site. Genomic regions can be selected based on criteria positively correlated $n_{cancer}$ and inversely correlated with $n_{non-cancer}$. In other embodiments, target genomic region selection involves a calculation performed with respect to a plurality of CpG sites.

In some embodiments, the number of non-cancerous samples ($n_{non-cancer}$) and the number of cancerous samples ($n_{cancer}$) having an abnormally hypermethylated and/or hypomethylated cfDNA and/or ctDNA fragment overlapping a CpG site are counted. A ranking score is then calculated for the CpG site. In some embodiments, the ranking score is equal to $(n_{cancer}+1)/(n_{cancer}+n_{non-cancer}+2)$. CpG sites ranked by this metric are greedily added to a panel until the panel size budget is exhausted. The process of selecting genomic regions indicative of cancer is further detailed herein.

Further filtration can be performed to select probes with high specificity for enrichment (i.e., high binding efficiency) of nucleic acids derived from targeted genomic regions. Probes can be filtered to reduce non-specific binding (or off-target binding) to nucleic acids derived from non-targeted genomic regions. In some embodiments, further filtration is performed to select probes for a cancer assay panel that will not pull down off-target genomic regions. In some embodiments, probes that can pull down off-target genomic regions are eliminated. In some embodiments, a threshold is set to define probes with an unacceptably high risk of off-target effects. In one embodiment, probes with more than 80%, 85%, 90%, 95% or 98% identity to a threshold number (e.g., 1, 2, 3, 4, 5, 10, 15, 20, 25 or more) of off-target genomic regions are eliminated from a panel. In some embodiments, probes are eliminated from a cancer assay panel if they comprise a sequence of at least 20, 25, 30, 35, 40, 45, 50, 55, or 60 nt with more than 80%, 85%, 90%, 95% or 98% identity to a threshold number (e.g., 1, 2, 3, 4, 5, 10, 15, 20, 25 or more) of off-target genomic regions. Filtering removes repetitive probes that can pull down off-target fragments, which are not desired and can impact assay efficiency.

A fragment-probe overlap of at least 45 bp enables a non-negligible amount of pulldown under certain hybridization conditions. Thus, in some embodiments, probes are eliminated from a cancer panel if they comprise a sequence of at least 45 nt with more than 80%, 85%, 90%, 95% or 98% identity to 1, 2, 3, 4, 5, 10, 15, 20, 25 or more off-target genomic regions.

In some embodiments, the probes of a cancer assay panel are designed to hybridize to converted cfDNA derived from target genomic regions. After hybridization, target polynucleotides can be recovered and/or isolated, optionally amplified, and sequenced by any suitable method. The sequence reads provide information relevant for detection of cancer, diagnosis of cancer, and assessment of a cancer tissue of origin or type of cancer. To this end, a panel may be designed to include a plurality of probes that can capture fragments that can together provide information relevant to cancer detection and diagnosis of cancer. In some embodiments, a panel includes at least 50, 60, 70, 80, 90, 100, 120, 150, or 200 different pairs of probes. In other embodiments, a panel includes at least at least 500, 1,000, 2,000, 2,500, 5,000, 10,000, 12,000, 15,000, 20,000, 30,000, 40,000, 50,000, or 100,000 probes. The plurality of probes together can comprise at least 20,000, 30,000, 40,000, 50,000, 75,000, 0.1 million, 0.2 million, 0.4 million, 0.6 million, 0.8 million, 1 million, 2 million, 3 million, 4 million, 5 million, 6 million, 7 million, 8 million, 9 million, or 10 million nucleotides. Optionally, the sequence at one or both ends of a probe overlaps with the sequence of other probes targeting the same genomic region or an adjacent genomic region.

Specifically, in some embodiments, the cancer assay panel comprises at least 50 pairs of probes, wherein each pair of the at least 50 pairs comprises two probes configured to overlap each other by an overlapping (e.g., identical) sequence, wherein the overlapping sequence comprises a 30-nucleotide sequence, and wherein the 30-nucleotide sequence is configured to hybridize to a modified fragment obtained from processing of the cfDNA molecules corresponding to one or more genomic regions, wherein each of the genomic regions comprises at least five methylation sites, and wherein the at least five methylation sites have an anomalous methylation pattern in training samples. In other words, when cfDNA molecules in training samples corresponding to the genomic region are analyzed, they have methylation status vectors appearing less frequently than a threshold value in reference samples.

In other embodiments, the cancer assay panel comprises at least 500 pairs of probes, wherein each pair of the at least 500 pairs comprises two probes configured to overlap each other by an overlapping sequence, wherein the overlapping sequence comprises a 30-nucleotide sequence, and wherein the 30-nucleotide sequence is configured to hybridize to a modified fragment obtained from processing of the cfDNA molecules corresponding to one or more genomic regions, wherein each of the genomic regions comprises at least five methylation sites, and wherein the at least five methylation sites have an anomalous methylation pattern in training samples. Again, when cfDNA molecules in training samples corresponding to the genomic region are analyzed, they have methylation status vectors appearing less frequently than a threshold value in reference samples.

In a preferred embodiment, the at least five methylation sites are differentially methylated either between cancerous and non-cancerous samples or between one or more pairs of samples from different cancer types. In some embodiments, the converted cfDNA molecules comprise cfDNA molecules treated (e.g., via bisulfite treatment or enzymatic conversion) to convert unmethylated C (cytosine) to U (uracil). In some cases, the uracil is further converted to thymine (e.g., upon PCR amplification).

The selected target genomic regions are optionally located in various positions in a genome, including but not limited to promoters, enhancers, exons, introns, and intergenic regions. In certain embodiments, the target genomic regions comprise genes and/or transcriptional control regions that are differentially expressed in cancer versus non-cancer, in different stages of cancer, and/or in cancers arising from different tissues of origin.

A cancer assay panel designed by methods provided herein may comprise at least 1,000 pairs of probes, each pair of which comprises two probes configured to overlap each other by an overlapping sequence comprising a 30-nucleotide fragment. The 30-nucleotide fragment comprises at least three, at least four, at least five of more CpG sites, wherein at least 70%, at least 80%, or at least 90% of the at least three, at least four, at least five, or more CpG sites are either CpG or UpG. The 30-nucleotide fragment is configured to bind to one or more cfDNA fragments derived from genomic regions in cancerous samples, wherein the one or more genomic regions have at least three, at least four, at least five or more methylation sites with an abnormal methylation pattern compared to DNA molecules from a non-cancer sample.

Another cancer assay panel comprises at least 2,000 probes, each of which is designed as a hybridization probe complementary to one or more genomic regions. Each of the genomic regions is selected based on the criteria that it comprises (i) at least 30 nucleotides, and (ii) at least three, at least four, at least five, or more methylation sites, wherein the at least five methylation sites have an abnormal methylation pattern and are either hypomethylated or hypermethylated.

In some instances, primers may be used to specifically amplify targets/biomarkers of interest (e.g., by PCR), thereby enriching the sample for desired targets/biomarkers (optionally without hybridization capture). For example, forward and reverse primers can be prepared for each genomic region of interest and used to amplify fragments that correspond to or are derived from the desired genomic region. Thus, while the present disclosure pays particular attention to cancer assay panels and bait sets for hybridization capture, the disclosure is broad enough to encompass other methods for enrichment of cell-free DNA.

Accordingly, a skilled artisan, with the benefit of this disclosure, will recognize that methods analogous to those described herein in connection with hybridization capture can alternatively be accomplished by replacing hybridization capture with some other enrichment strategy, such as PCR amplification of cell-free DNA fragments that correspond with genomic regions of interest. In some embodiments, bisulfite padlock probe capture is used to enrich regions of interest, such as is described in Zhang et al. (US 2016/0340740). In some embodiments, additional or alternative methods are used for enrichment (e.g., non-targeted enrichment) such as reduced representation bisulfite sequencing, methylation restriction enzyme sequencing, methylation DNA immunoprecipitation sequencing, methyl-CpG-binding domain protein sequencing, methyl DNA capture sequencing, or microdroplet PCR.

6.3.1. Probes

Cancer assay panels provided herein may include a panel having a set of hybridization probes (also referred to herein as "probes") designed to enrich selected target genomic regions by pulling down nucleic acid fragments of interest. The probes are designed to interrogate the methylation status of target genomic regions (e.g., of a human or other organism) that are suspected to correlate with the presence or absence of cancer generally, cancer stage, and/or tissue of origin.

The probes can be designed to anneal (or hybridize) to a target (complementary) strand of DNA or RNA. The target strand can be the "positive" strand (e.g., the strand transcribed into mRNA and subsequently translated into a protein) or the complementary "negative" strand. In a particular embodiment, a cancer assay panel includes two sets of probes for a target genomic region, one targeting the positive strand and the other targeting the negative strand. In certain embodiments, probes targeting different strands of a DNA sequence can have regions of sequence complementarity to each other.

Probes are optionally designed to hybridize to native DNA or to converted DNA. cfDNA, ctDNA and/or chromosomal DNA can be converted by various methods known in the art to preserve epigenetic marks such as methylation.

Optionally, DNA is converted by bisulfite or enzymatic treatment, which converts unmethylated cytosines into uracils. Thus, the methylation pattern determines which cytosines in a CpG sequence are converted to uracil. Unmethylated CpG sites in a target region are converted by bisulfite (or enzymatic means) to UpG sites, If the target DNA is amplified after conversion by a process employing DNA polymerase, UpG sequences are further transformed to TpG sequences, and a complementary probe would have a CpA sequence. Methylated CpG sites in a target region retain their CpG sequence, so a complementary probe would also have a CpG sequence. Cytosines that are not at a CpG sequences are generally not methylated. These cytosines are generally converted to uracils, which are further transformed to thymidine after amplification, so probes complementary to bisulfite converted DNA comprise an A for each converted C that is not in a CpG site.

Probes are optionally designed under an assumption that all CpG sites are methylated in some target genomic regions (perfect hypermethylation), whereas no CpG sites are methylated in other target genomic regions (perfect hypomethylation). Stated differently, probes designed to target a hypomethylated region may be designed to be complementary to a region in which all CpG sites have been converted UpGs, whereas probes designed to target a hypermethylated region may be designed to be complementary to a region in which none of the CpG sites have been converted.

Since the probes may be configured to hybridize to a converted DNA or converted cfDNA molecule derived from one or more genomic regions, the probes can have a sequence different from the targeted genomic region. For example, a DNA molecule containing unmethylated CpG site will be converted to include UpG because unmethylated cytosines are converted to uracils by a conversion reaction (e.g., bisulfite treatment). As a result, a probe is configured to hybridize to a sequence including UpG instead of a naturally existing unmethylated CpG. Accordingly, a complementary site in the probe to the unmethylated site can comprise CpA instead of CpG, and some probes targeting a hypomethylated site where all methylation sites are unmethylated can have no guanine (G) bases. In some embodiments, at least 3%, 5%, 10%, 15%, 20%, 30%, or 40% of the probes lack G (Guanine). In some embodiments, at least 80, 85, 90, 92, 95, 98% of the probes on the panel have exclusively either CpG or CpA on CpG detection sites. Accordingly, in some embodiments, polynucleotide-containing probes have a nucleic acid sequence that is either (1) identical in sequence to a sequence within a target genomic region (e.g., target genomic regions set forth herein in any one of Lists 1-8) or (2) varies with respect to a sequence within the genomic region only one or more transitions (e.g., changes in base composition at a site due to bisulfate conversion or other conversion techniques), wherein each respective transition in the one or more transitions occurs at a nucleotide corresponding to a CpG site in the genomic region.

In some embodiments, probes on the panel comprise less than 20, 15, 10, 8, or 6 CpG detection sites. In some embodiments, probes on the panel comprise more than 5, 6, 7, 8, 9, or 10 CpG detection sites.

In some embodiments, probes are conjugated to a tag (e.g., a non-nucleic acid affinity moiety), such as a biotin moiety. In some embodiments, probes are affixed to a solid support, such as an array.

A cancer assay panel that interrogates methylation status can also be designed to interrogate other genetic or epigenetic marks that are different between cfDNA in cancer and healthy samples. In some embodiments, probes are designed to enrich for all cfDNA from a particular target region regardless of the methylation status of the cfDNA molecule. This might be because the target genomic region is not highly methylated or unmethylated, or for the purpose of targeting small mutations or SCNAs rather than methylation changes.

The probes optionally range in length from 10s to 100s of nucleotides. The probes can comprise at least 20, 30, 50, 75, 100, or 120 nucleotides. The probes can have a length of less than 300, 250, 200, or 150 nucleotides. In some embodiments, the probes comprise 100-150 nucleotides. In one particular embodiment, the probes are 120 nucleotides in length.

In some embodiments, the probes are designed in a "2× tiled" fashion to cover overlapping portions of a target region. Each probe optionally overlaps in coverage at least partially with another probe in the library. In such embodiments, the panel contains multiple pairs of probes, with each probe in a pair overlapping the other by at least 25, 30, 35, 40, 45, 50, 60, 70, 75 or 100 nucleotides. In some embodiments, the overlapping sequence can be designed to be complementary to a target genomic region (or cfDNA derived therefrom) or to be complementary to a sequence with homology to a target region or cfDNA. Thus, in some embodiments, at least two probes are complementary to the same sequence within a target genomic region, and a nucleotide fragment corresponding to or derived from the target genomic region can be bound and pulled down by at least one of the probes. Other levels of tiling are possible, such as 3× tiling, 4× tiling, etc., wherein each nucleotide in a target region can bind to more than two probes.

Figure 1A:
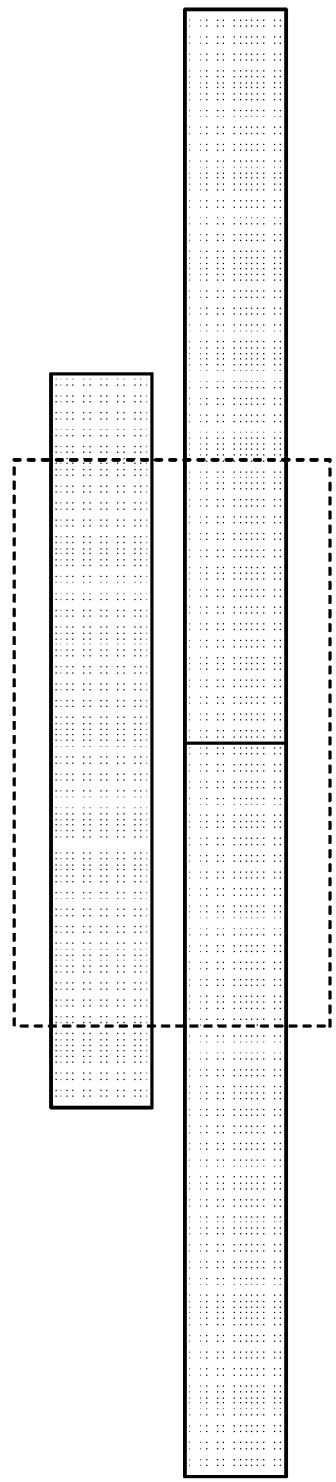
FIGS. 1A-1B illustrate a 2× tiled probe design where, for each strand of DNA, each base in a target region (boxed in the dotted rectangles) is covered by (e.g., complementary to) exactly two probes.
Figure 1B:
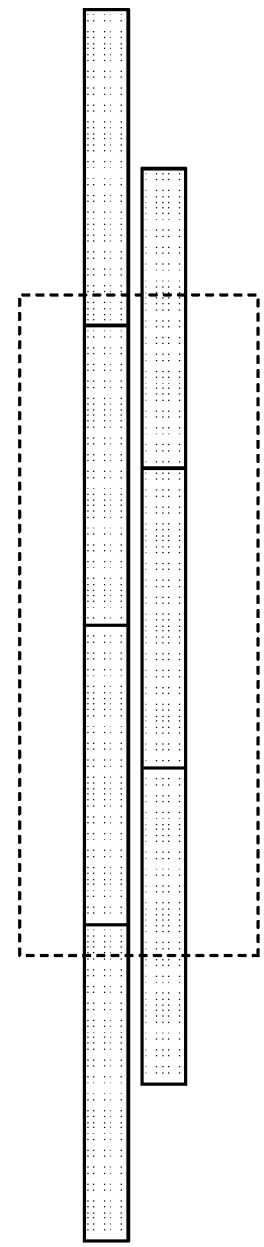

In one embodiment, each base in a target genomic region is overlapped by exactly two probes, as illustrated in FIG. 1. A single pair of probes is enough to pull down a genomic region if the overlap between the two probes is longer than the target genomic region and extends beyond both ends of the target genomic region. In some instances, even relatively small target regions may be targeted with three probes (see FIG. 1A). A probe set comprising three or more probes is optionally used to capture a larger genomic region. See FIG. 1B. In some embodiments, subsets of probes will collectively extend across an entire genomic region (e.g., may be complementary to non-converted or converted fragments from the genomic region). A tiled probe set optionally comprises probes that collectively include at least two probes that overlap every nucleotide in the genomic region. FIGS. 1A and 1B. This is done to ensure that cfDNAs comprising a small portion of a target genomic region at one end will have a substantial overlap extending into the adjacent non-targeted genomic region with at least one probe, to provide for efficient capture.

For example, a 100 bp cfDNA fragment comprising a 30 nt target genomic region can be guaranteed to have at least 65 bp overlap with at least one of the overlapping probes. Other levels of tiling are possible. For example, to increase target size and add more probes in a panel, probes can be designed to expand a 30 bp target region by at least 70 bp, 65 bp, 60 bp, 55 bp, or 50 bp. To capture any fragment that overlaps the target region at all (even if by only 1 bp), the probes can be designed to extend past the ends of the target region on either side.

In one particular embodiment, the smallest target genomic region is 30 bp. When a new CpG site is added to the panel (based on the greedy selection as described above), a new target of 30 nt is centered on the CpG site of interest. Then, it is checked whether each edge of this new target is close enough to other targets such that they can be merged. Merging avoids a panel comprising close but distinct targets with overlapping probes. This is based on a "merge distance" parameter which extends about 100 nt, 150 nt, 200 nt, 250 nt, or 300 nt on either side of every target region. Merger creates a larger target genomic region. If a new CpG site is merged into targets on both sides, the number of target genomic regions is reduced.

In some embodiments, an assay panel provided herein comprises a plurality of polynucleotide probes configured to hybridize to a modified fragment obtained from processing of the cfDNA molecules, wherein each of the cfDNA molecules corresponds to or is derived from one or more genomic regions. In some embodiments, at least 15%, 20%, 30%, or 40% of the genomic regions are in exons or introns. In some embodiments, at least 5%, 10%, 15%, 20%, 30% or 40% of the genomic regions are in exons. In some embodiments, less than 5%, 10%, 15%, 20%, 25%, or 30% of the genomic regions are in intergenic regions.

In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of Lists 1-8. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 1. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 2. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 3. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 5. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 7. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 8. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of List 4. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 6. In some embodiments, the entire probes on the panel together are configured to hybridize to modified fragments obtained from the cfDNA molecules corresponding to or derived from at least 500, 1,000, 5000, 10,000 or 15,000 genomic regions in one or more of Lists 1-8.

6.4. Methods of Selecting Target Genomic Regions

In another aspect, methods are provided for identifying anomalously methylated DNA molecules from a sample. In some embodiments, the methods disclosed herein can be used to select target genomic regions for detecting cancer, assessing a cancer tissue of origin, or type of cancer. The targeted genomic regions can be used to design and manufacture probes for a cancer assay panel. Methylation status of the target genomic regions can be screened using the cancer assay panel. In other embodiments, these methods can be used as part of a filtering process to limit a data set (e.g., a sequencing data set) to reduce subsequent processing or analysis requirements. For example, the methods disclosed herein can be used to set a threshold for anomalously methylated fragments, which are likely derived from cancer or cancer cells, and the threshold used as a to filter out sequence reads or fragments that don't meet the threshold, and thus, are more likely derived from healthy cells.

6.4.1. Generation of Data Structure

Figure 2:
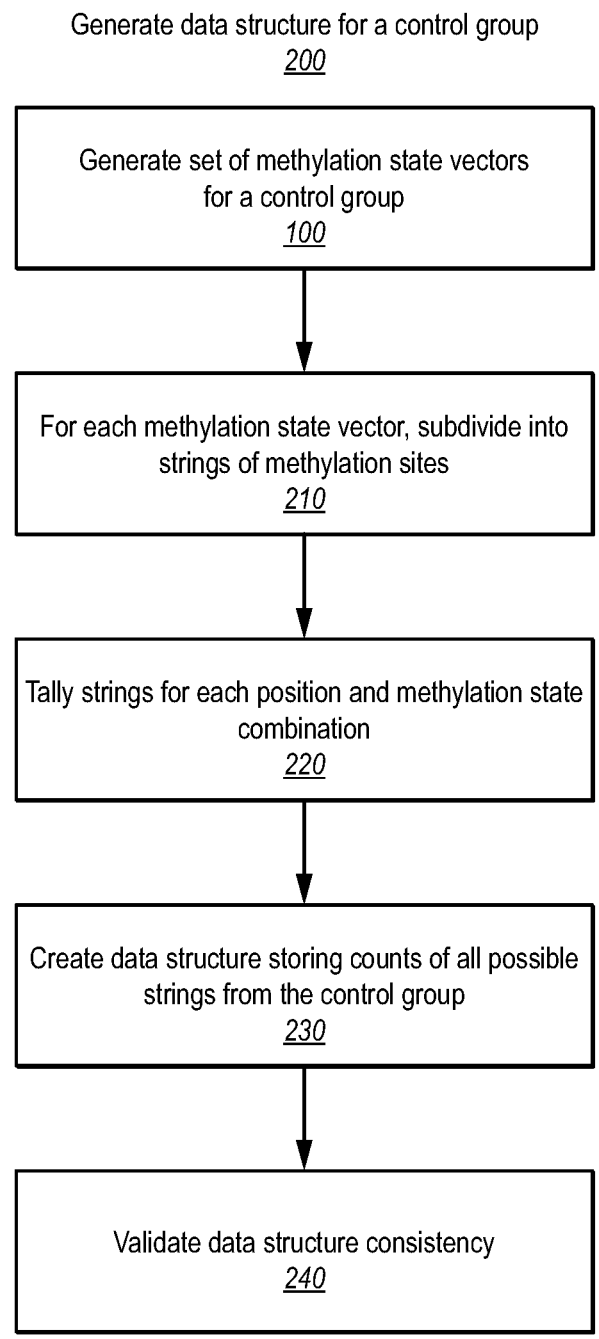
FIG. 2 is a flowchart describing a process of creating a data structure for a control group, according to an embodiment.

FIG. 2 is a flowchart describing a process 200 of generating a data structure for a healthy control group, according to an embodiment. To create a healthy control group data structure, the analytics system receives sequences from a plurality of DNA fragments (e.g., cfDNA and/or ctDNA) from a plurality of healthy subjects. A methylation state vector is identified for each fragment, for example via the process 100.

The analytics system subdivides 210 the methylation state vector of each DNA fragment into strings of CpG sites. In one embodiment, the analytics system subdivides 210 the methylation state vector such that the resulting strings are all less than a given length. For example, dividing a methylation state vector of length 11 may be subdivided into strings of length less than or equal to 3 would result in 9 strings of length 3, 10 strings of length 2, and 11 strings of length 1. In another example, a methylation state vector of length 7 being subdivided into strings of length less than or equal to 4 would result in 4 strings of length 4, 5 strings of length 3, 6 strings of length 2, and 7 strings of length 1. If the methylation state vector resulting from a DNA fragment is shorter than or the same length as the specified string length, then the methylation state vector may be converted into a single string containing all CpG sites of the vector.

The analytics system tallies 220 the strings by counting, for each possible CpG site and possibility of methylation states in the vector, the number of strings present in the control group having the specified CpG site as the first CpG site in the string and having that possibility of methylation states. For a string length of three at a given CpG site, there are 2^3 or 8 possible string configurations. For each CpG site, the analytics system tallies 220 how many occurrences of each possible methylation state vector appear up in the control group. This may involve tallying the following quantities: $<M_x, M_{x+1}, M_{x+2}>$, $<M_x, M_{x+1}, U_{x+2}>$, ..., $<U_x, U_{x+1}, U_{x+2}>$ for each starting CpG site in the reference genome. The analytics system creates 230 a data structure storing the tallied counts for each string possibility at each starting CpG.

There are several benefits to setting an upper limit on string length. First, depending on the maximum length for a string, the size of the data structure created by the analytics system can dramatically increase in size. For instance, a maximum string length of 4 means that there are at most $2^4$ numbers to tally at every CpG. Increasing the maximum string length to 5 doubles the possible number of methylation states to tally. Reducing string size helps reduce the computational and data storage burden of the data structure. In some embodiments, the string size is 3. In some embodiments, the string size is 4. A second reason to limiting the maximum string length is to avoid overfitting downstream models. Calculating probabilities based on large strings of CpG sites can be problematic if the long CpG strings do not have a strong biological effect on the outcome (e.g., predictions of anomalousness that predictive of the presence of cancer), as it requires a significant amount of data that may not be available, and would thus be too sparse for a model to perform appropriately. For example, calculating a probability of anomalousness/cancer conditioned on the prior 100 CpG sites would require counts of strings in the data structure of length 100, ideally some matching exactly the prior 100 methylation states. If only sparse counts of strings of length 100 are available, there will be insufficient data to determine whether a given string of length of 100 in a test sample is anomalous or not.

6.4.1. Validation of Data Structure

Once the data structure has been created, the analytics system may seek to validate 240 the data structure and/or any downstream models making use of the data structure.

This first type of validation ensures that potential cancerous samples are removed from the healthy control group so as to introduce bias into the healthy data structure. This type of validation checks consistency within the control group's data structure. For example, the healthy control group may contain a sample from an individual with an undiagnosed cancer that contains a plurality of anomalously methylated fragments. The analytics system may perform various calculations to determine whether to exclude data from a subject with apparently undiagnosed cancer.

A second type of validation checks the probabilistic model used to calculate p-values with the counts from the data structure itself (i.e., from the healthy control group). A process for p-value calculation is described below in conjunction with FIG. 5. Once the analytics system generates a p-value for the methylation state vectors in the validation group, the analytics system builds a cumulative density function (CDF) with the p-values. With the CDF, the analytics system may perform various calculations on the CDF to validate the control group's data structure. One test uses the fact that the CDF should ideally be at or below an identity function, such that $CDF(x) \leq x$. On the converse, being above the identity function reveals some deficiency within the probabilistic model used for the control group's data structure. For example, if 1/100 of fragments have a p-value score of 1/1000 meaning $CDF(1/1000)=1/100>1/1000$, then the second type of validation fails indicating an issue with the probabilistic model. See e.g., U.S. application Ser. No. 16/352,602, published as U.S. Publ. No. 2019/0287652, which is hereby incorporated by reference in its entirety.

A third type of validation uses a healthy set of validation samples separate from those used to build the data structure. This tests if the data structure is properly built and the model works. An exemplary process for carrying out this type of validation is described below in conjunction with FIG. 3. The third type of validation can quantify how well the healthy control group generalizes the distribution of healthy samples. If the third type of validation fails, then the healthy control group does not generalize well to the healthy distribution.

A fourth type of validation tests with samples from a non-healthy validation group. The analytics system calculates p-values and builds the CDF for the non-healthy validation group. With a non-healthy validation group, the analytics systems expects to see the $CDF(x)>x$ for at least some samples or, stated differently, the converse of what was expected in the second type of validation and the third type of validation with the healthy control group and the healthy validation group. If the fourth type of validation fails, then this is indicative that the model is not appropriately identifying the anomalousness that it was designed to identify.

Figure 3:
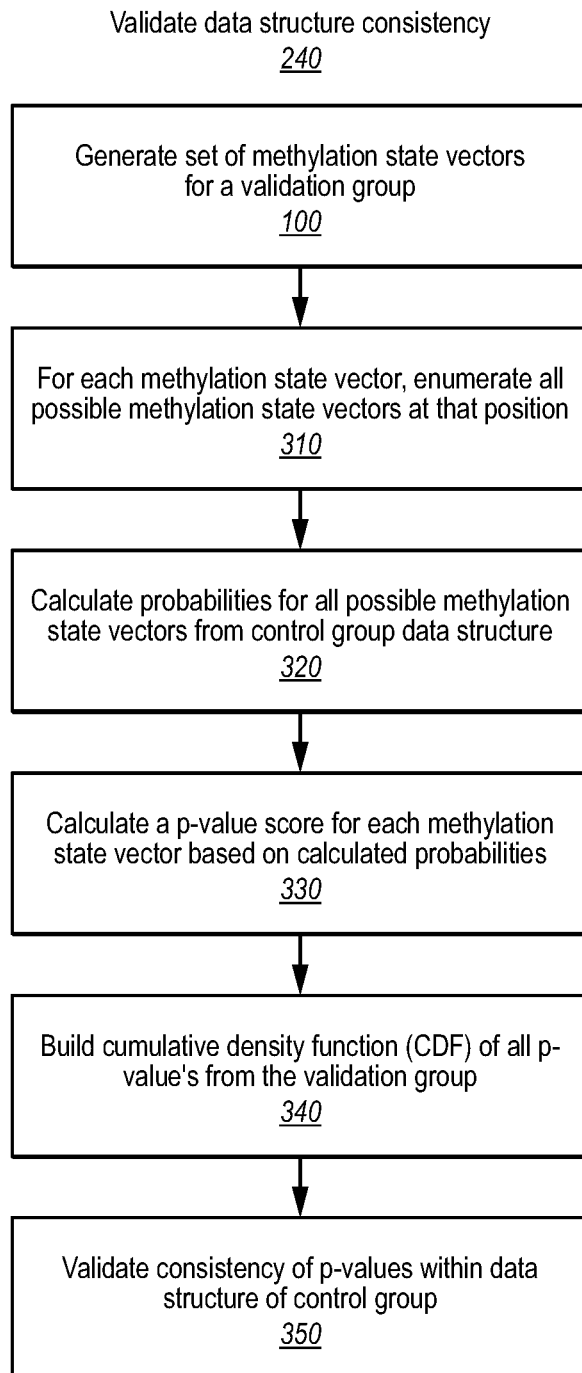
FIG. 3 is a flowchart describing an additional step of validating the data structure for the control group of FIG. 2, according to an embodiment.

FIG. 3 is a flowchart describing an additional step 240 of validating the data structure for the control group of FIG. 2, according to an embodiment. In this step 240 of validating the data structure, the analytics system performs the fourth type of validation test as described above which utilizes a validation group with a supposedly similar composition of subjects, samples, and/or fragments as the control group. For example, if the analytics system selected healthy subjects without cancer for the control group, then the analytics system also uses healthy subjects without cancer in the validation group.

The analytics system takes the validation group and generates 100 a set of methylation state vectors as described in FIG. 2. The analytics system performs a p-value calculation for each methylation state vector from the validation group. The p-value calculation process will be further described in conjunction with FIGS. 4 & 5. For each possible methylation state vector, the analytics system calculates 320 a probability from the control group's data structure. Once the probabilities are calculated for the possibilities of methylation state vectors, the analytics system calculates 330 a p-value score for that methylation state vector based on the calculated probabilities. The p-value score represents an expectedness of finding that specific methylation state vector and other possible methylation state vectors having even lower probabilities in the control group. A low p-value score, thereby, generally corresponds to a methylation state vector which is relatively unexpected in comparison to other methylation state vectors within the control group, whereas a high p-value score generally corresponds to a methylation state vector which is relatively more expected in comparison to other methylation state vectors found in the control group. Once the analytics system generates a p-value score for the methylation state vectors in the validation group, the analytics system builds 340 a cumulative density function (CDF) with the p-value scores from the validation group. The analytics system validates 370 consistency of the CDF as described above in the fourth type of validation tests.

6.4.2. Anomalously Methylated Fragments

Figure 4:
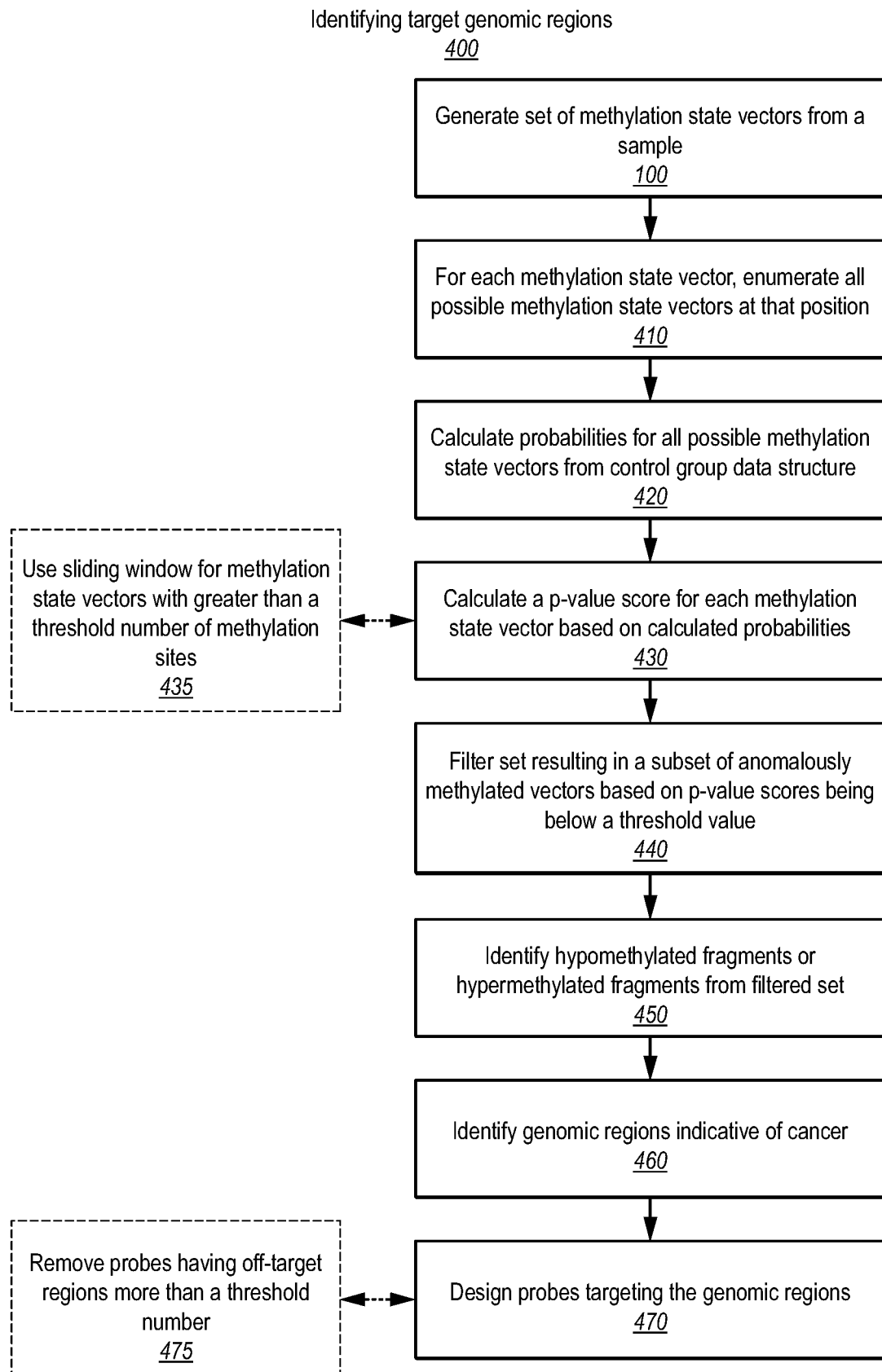
FIG. 4 is a flowchart describing a process for selecting genomic regions for designing probes for a cancer assay panel, according to an embodiment.

Anomalously methylated fragments having abnormal methylation patterns are selected as target genomic regions, according to an embodiment as outlined in FIG. 4. An exemplary process of selected anomalously methylated fragments 440 is visually illustrated in FIG. 5, and is further described below the description of FIG. 4. In process 400, the analytics system generates 100 methylation state vectors from cfDNA fragments of the sample. The analytics system handles each methylation state vector as follows.

In some embodiments, the analytics system filters 405 fragments having indeterminate states at one or more CpG sites. In such embodiments, the analytics system implements a prediction model to identify fragments not likely to have an anomalous methylation pattern for filtering. For a sample fragment, the prediction model calculates a sample probability that the sample fragment's methylation state vector occurs in comparison to the healthy control group data structure. The prediction model randomly samples a subset of possible methylation state vectors encompassing the CpG sites in the sample fragment's methylation state vector. The prediction model calculates a probability corresponding to each of the sampled possible methylation state vectors. Probability calculations for the fragment's methylation state vector and the sampled possible methylation state vectors can be calculated according to a Markov chain model as will be described below in Section 6.4.2.1 ("P-Value Score Calculation"). The prediction model calculates a proportion of the sampled possible methylation state vectors corresponding to probabilities less than or equal to the sample probability. The prediction model generates an estimated p-value score for the fragment based on the calculated proportion. The prediction model may filter fragments corresponding to p-value scores above a threshold and retain fragments corresponding to p-value scores below the threshold. Again, see e.g., U.S. application Ser. No. 16/352,602, published as U.S. Publ. No. 2019/0287652, which is hereby incorporated by reference in its entirety.

In additional embodiments, the prediction model may calculate a confidence probability that is used by the prediction model to determine when to continue or when to terminate sampling. The confidence probability describes how likely it is that a fragment's true p-value score is below a threshold based on the estimated p-value score and the probabilities of the sampled possible methylation state vectors. The prediction model may sample one or more possible additional methylation state vectors while iteratively calculating the estimated p-value score and the confidence probability. The prediction model may then terminate sampling when the confidence probability is above a confidence threshold.

For a given methylation state vector, the analytics system enumerates 410 all possible methylation state vectors having the same starting CpG site and same length (i.e., set of CpG sites) as the methylation state vector. There are only two possible states at each CpG site, methylated or unmethylated, and thus the count of distinct possibilities of methylation state vectors depends on a power of 2, such that a methylation state vector of length n would be associated with $2^n$ possible of methylation state vectors. With methylation state vectors inclusive of indeterminate states for one or more CpG sites, the analytics system may enumerate 410 possibilities of methylation state vectors considering only CpG sites that have observed states.

The analytics system calculates 420 the probability of observing each possible methylation state vector for the identified starting CpG site/methylation state vector length by accessing the healthy control group data structure. In one embodiment, calculating the probability of observing a given possibility uses Markov chain probability to model the joint probability calculation which will be described in greater detail with respect to FIG. 5. In other embodiments, calculation methods other than Markov chain probabilities are used to determine the probability of observing each possible methylation state vector.

The analytics system calculates 430 a p-value score for the methylation state vector using the calculated probabilities for each possibility. In one embodiment, this includes determining the calculated probability corresponding to the possibility that matches the methylation state vector in question. Specifically, this is the probability of having the same set of CpG sites, or the same starting CpG site, length and methylation status as the methylation state vector. The analytics system sums the calculated probabilities of any possibilities having probabilities less than or equal to the identified probability to generate the p-value score.

This p-value represents the probability of observing the methylation state vector of the fragment or other methylation state vectors even less probable in the healthy control group. A low p-value score, thereby, generally corresponds to a methylation state vector which is rare in a healthy subject, and which causes the fragment to be labeled anomalously methylated, relative to the healthy control group. A high p-value score generally relates to a methylation state vector is expected to be present, in a relative sense, in a healthy subject. If the healthy control group is a non-cancerous group, for example, a low p-value indicates that the fragment is anamolously methylated relative to the non-cancer group, and therefore possibly indicative of the presence of cancer in the test subject.

As above, the analytics system calculates p-value scores for each of a plurality of methylation state vectors, each representing a cfDNA and/or ctDNA fragment in the test sample. To identify which of the fragments are anomalously methylated, the analytics system may filter 440 the set of methylation state vectors based on their p-value scores. In one embodiment, filtering is performed by comparing the p-values scores against a threshold and keeping only those fragments below the threshold. This threshold p-value score could be on the order of 0.1, 0.01, 0.001, 0.0001, or similar.

6.4.2.1. P-Value Score Calculation

Figure 5:
FIG. 5 is an illustration of an example p-value score calculation, according to an embodiment.

FIG. 5 is an illustration 500 of an example p-value score calculation, according to an embodiment. To calculate a p-value score given a test methylation state vector 505, the analytics system takes that test methylation state vector 505 and enumerates 410 possibilities of methylation state vectors. In this illustrative example, the test methylation state vector 505 is $<M_{23}, M_{24}, M_{25}, U_{26}>$. As the length of the test methylation state vector 505 is 4, there are $2^4$ possibilities of methylation state vectors encompassing CpG sites 23-26. In a generic example, the number of possibilities of methylation state vectors is $2^n$, where n is the length of the test methylation state vector or alternatively the length of the sliding window (described further below).

The analytics system calculates 420 probabilities 515 for the enumerated possible methylation state vectors. As methylation is conditionally dependent on methylation state of nearby CpG sites, one way to calculate the probability of observing a given methylation state vector possibility is to use a Markov chain model. Generally, a methylation state vector such as $<S_1, S_2, S_n>$, where S denotes the methylation state whether methylated (denoted as M), unmethylated (denoted as U), or indeterminate (denoted as I), has a joint probability that can be expanded using the chain rule of probabilities as:

$$P(<S_1,S_2,\ldots,S_n>)=P(S_n|S_1,\ldots,S_{n-1})*$$
$$P(S_{n-1}|S_1,\ldots,S_{n-2})* \ldots *P(S_2|S_1)*P(S_1).$$

A Markov chain model can be used to calculate the conditional probabilities of each possibility more efficiently. In one embodiment, the analytics system selects a Markov chain order k which corresponds to how many prior CpG sites in the vector (or window) to consider in the conditional probability calculation, such that the conditional probability is modeled as $P(S_n|S_1, \ldots S_{n-1}) \sim P(S_n|S_{n-k-2}, \ldots, S_{n-1})$.

To calculate each Markov modeled probability for a possibility of methylation state vector, the analytics system accesses the control group's data structure, specifically the counts of various strings of CpG sites and states. To calculate $P(M_n\ S_{n-k-2}, \ldots, S_{n-1})$, the analytics system takes a ratio of the stored count of the number of strings from the data structure matching $<S_{n-k-2}, \ldots, S_{n-1}, M_n>$ divided by the sum of the stored count of the number of strings from the data structure matching $<S_{n-k-2}, \ldots, S_{n-1}, M_n>$ and $<S_{n-k-2}, \ldots, S_{n-1}, U_n>$. Thus, $P(M_n|S_{n-k-2}, \ldots, S_{n-1})$, is calculated ratio having the form:

$$\frac{\#\ of\ <S_{n-k-2,\ldots},S_{n-1},M_n>}{\#\ of\ <S_{n-k-2,\ldots},S_{n-1},M_n> + \#\ of\ <S_{n-k-2,\ldots},S_{n-1},U_n>}.$$

The calculation may additionally implement a smoothing of the counts by applying a prior distribution. In one embodiment, the prior distribution is a uniform prior as in Laplace smoothing. As an example of this, a constant is added to the numerator and another constant (e.g., twice the constant in the numerator) is added to the denominator of the above equation. In other embodiments, an algorithmic technique such as Knesser-Ney smoothing is used.

In the illustration, the above denoted formulas are applied to the test methylation state vector 505 covering sites 23-26. Once the calculated probabilities 515 are completed, the analytics system calculates 430 a p-value score 525 that sums the probabilities that are less than or equal to the probability of possibility of methylation state vector matching the test methylation state vector 505.

In embodiments with indeterminate states, the analytics system may calculate a p-value score summing out CpG sites with indeterminates states in a fragment's methylation state vector. The analytics system identifies all possibilities that have consensus with all methylation states of the methylation state vector, excluding the indeterminate states. The analytics system may assign the probability to the methylation state vector as a sum of the probabilities of the identified possibilities. As an example, the analytics system calculates a probability of a methylation state vector of $<M_1, I_2, U_3>$ as a sum of the probabilities for the possibilities of methylation state vectors of $<M_1, M_2, U_3>$ and $<M_1, U_2, U_3>$ since methylation states for CpG sites 1 and 3 are observed and in consensus with the fragment's methylation states at CpG sites 1 and 3. This method of summing out CpG sites with indeterminate states uses calculations of probabilities of possibilities up to $2^i$, wherein i denotes the number of indeterminate states in the methylation state vector. In additional embodiments, a dynamic programming algorithm may be implemented to calculate the probability of a methylation state vector with one or more indeterminate states. Advantageously, the dynamic programming algorithm operates in linear computational time.

In one embodiment, the computational burden of calculating probabilities and/or p-value scores may be further reduced by caching at least some calculations. For example, the analytic system may cache in transitory or persistent memory calculations of probabilities for possibilities of methylation state vectors (or windows thereof). If other fragments have the same CpG sites, caching the possibility probabilities allows for efficient calculation of p-value scores without needing to re-calculate the underlying possibility probabilities. Equivalently, the analytics system may calculate p-value scores for each of the possibilities of methylation state vectors associated with a set of CpG sites from vector (or window thereof). The analytics system may cache the p-value scores for use in determining the p-value scores of other fragments including the same CpG sites.

Generally, the p-value scores of possibilities of methylation state vectors having the same CpG sites may be used to determine the p-value score of a different one of the possibilities from the same set of CpG sites.

6.4.2.2. Sliding Window

In one embodiment, the analytics system uses 435 a sliding window to determine possibilities of methylation state vectors and calculate p-values. Rather than enumerating possibilities and calculating p-values for entire methylation state vectors, the analytics system enumerates possibilities and calculates p-values for only a window of sequential CpG sites, where the window is shorter in length (of CpG sites) than at least some fragments (otherwise, the window would serve no purpose). The window length may be static, user determined, dynamic, or otherwise selected.

In calculating p-values for a methylation state vector larger than the window, the window identifies the sequential set of CpG sites from the vector within the window starting from the first CpG site in the vector. The analytic system calculates a p-value score for the window including the first CpG site. The analytics system then "slides" the window to the second CpG site in the vector, and calculates another p-value score for the second window. Thus, for a window size l and methylation vector length m, each methylation state vector will generate m−l+1 p-value scores. After completing the p-value calculations for each portion of the vector, the lowest p-value score from all sliding windows is taken as the overall p-value score for the methylation state vector. In another embodiment, the analytics system aggregates the p-value scores for the methylation state vectors to generate an overall p-value score.

Using the sliding window helps to reduce the number of enumerated possibilities of methylation state vectors and their corresponding probability calculations that would otherwise need to be performed. Example probability calculations are shown in FIG. 5, but generally the number of possibilities of methylation state vectors increases exponentially by a factor of 2 with the size of the methylation state vector. To give a realistic example, it is possible for fragments to have upwards of 54 CpG sites. Instead of computing probabilities for $2^{54}$ (~$1.8\times10^{16}$) possibilities to generate a single p-score, the analytics system can instead use a window of size 5 (for example) which results in 50 p-value calculations for each of the 50 windows of the methylation state vector for that fragment. Each of the 50 calculations enumerates $2^5$ (32) possibilities of methylation state vectors, which total results in $50\times2^5$ ($1.6\times10^3$) probability calculations. This results in a vast reduction of calculations to be performed, with no meaningful hit to the accurate identification of anomalous fragments. This additional step can also be applied when validating 240 the control group with the validation group's methylation state vectors.

6.4.3. Analysis of Hyper or Hypomethylated Fragments

In some embodiments, an additional filtration step can be performed to identify genomic regions that can be targeted for detection of cancer, a cancer tissue of origin, or a type of cancer.

Figure 6:
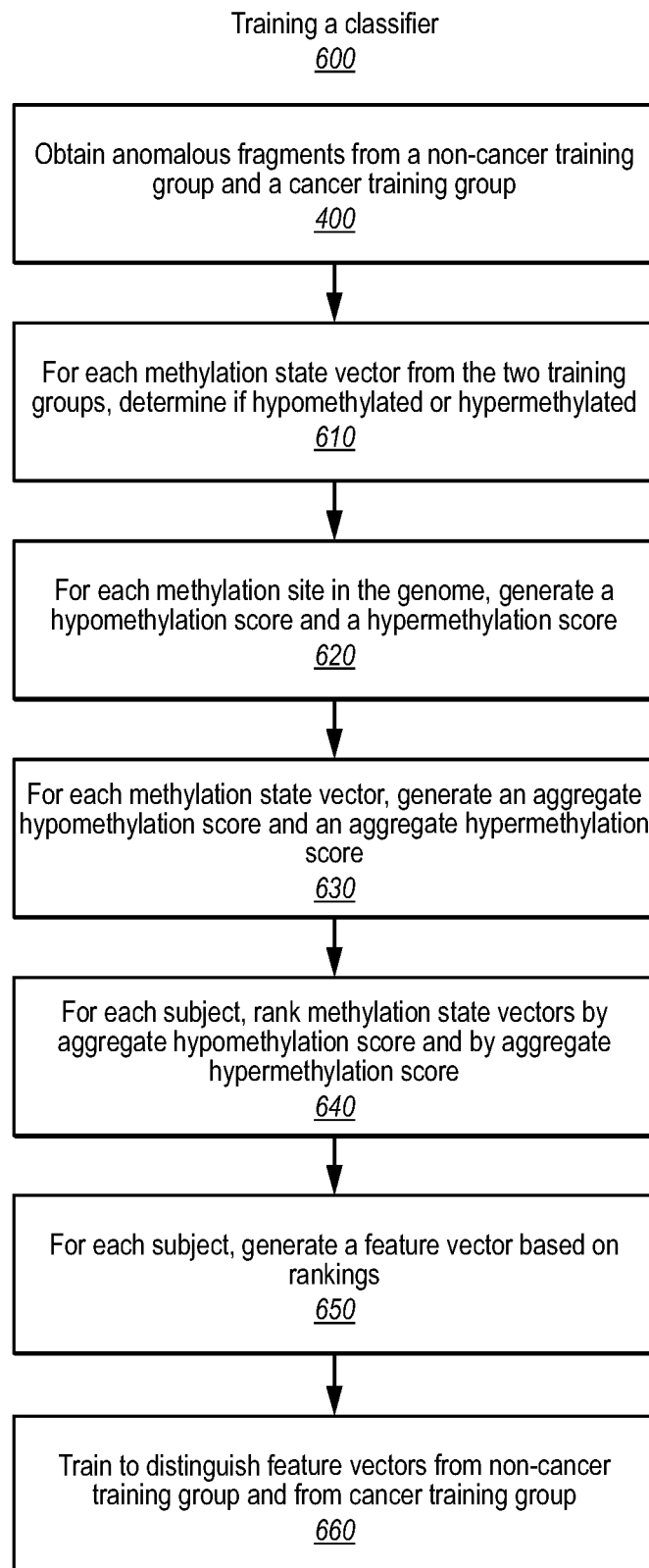
FIG. 6 is a flowchart describing a process of training a classifier based on the methylation statuses of fragments, according to an embodiment.

The analytics system may perform any variety and/or possibility of additional analyses with the set of anomalously methylated fragments. One additional analysis identifies 450 hypomethylated fragments or hypermethylated fragments from the filtered set. Fragments that are hypomethylated or hypermethylated can be defined as fragments of a certain length of CpG sites (e.g., more than 3, 4, 5, 6, 7, 8, 9, 10, etc.) with a high percentage of methylated CpG sites (e.g., more than 80%, 85%, 90%, or 95%, or any other percentage within the range of 50%-100%) or a high percentage of unmethylated CpG sites (e.g., more than 80%, 85%, 90%, or 95%, or any other percentage within the range of 50%-100%), respectively. FIG. 6, described below, illustrates an exemplary process for identifying these anomalously hypermethylated or hypomethylated portions of a genome based on the set of anomalously methylated fragments.

An alternate analysis applies 460 a trained classification model on the set of anomalous fragments. The trained classification model can be trained to identify any condition of interest that can be identified from the methylation state vectors. In one embodiment, the trained classification model is a binary classifier trained based on methylation states for cfDNA fragments obtained from a subject cohort with cancer, and optionally based on methylation states for cfDNA fragments obtained from a healthy subject cohort without cancer, and is then used to classify a test subject probability of having cancer, or not having cancer, based on anomalously methylation state vectors. In further embodiments, different classifiers may be trained using subject cohorts known to have particular cancer (e.g., breast, lung, prostrate, etc.) to predict whether a test subject has those specific cancers.

In one embodiment, the classifier is trained based on information about hyper/hypo methylated regions from the process 450 and as described with respect to FIG. 6 below.

FIG. 6 is a flowchart describing a process 600 of training a classifier based on methylation status of cfDNA fragments, according to an embodiment. An analytics system may be used to perform the process 600. The process accesses two training groups of samples—a non-cancer group and a cancer group—and obtains 400 a non-cancer set of methylation state vectors and a cancer set of methylation state vectors comprising the anomalous fragments of the samples in each group. The anomalous fragments may be identified according to the process of FIG. 4, for example.

The analytics system determines 610, for each methylation state vector, whether the methylation state vector is hypomethylated or hypermethylated. Here, the hypermethylated or hypomethylated label is assigned if at least some number of CpG sites have a particular state (methylated or unmethylated, respectively) and/or have a threshold percentage of sites that are the particular state (again, methylated or unmethylated, respectively). In one example, cfDNA fragments are identified as hypomethylated or hypermethylated, respectively, if the fragment overlaps at least 5 CpG sites, and at least 80%, 90% or 100% of its CpG sites are methylated or at least 80%, 90%, or 100% are unmethylated.

In an alternate embodiment, the analytics system considers portions of the methylation state vector and determines whether the portion is hypomethylated or hypermethylated, and may distinguish that portion to be hypomethylated or hypermethylated. This alternative resolves missing methylation state vectors which are large in size but contain at least one region of dense hypomethylation or hypermethylation. This process of defining hypomethylation and hypermethylation can be applied in step 450 of FIG. 4.

In one embodiment, the analytics system generates 620 a hypomethylation score ($P_{hypo}$) and a hypermethylation score ($P_{hyper}$) per CpG site in the genome. To generate either score at a given CpG site, the classifier takes four counts at that CpG site—(1) count of (methylations state) vectors of the cancer set labeled hypomethylated that overlap the CpG site; (2) count of vectors of the cancer set labeled hypermethylated that overlap the CpG site; (3) count of vectors of the non-cancer set labeled hypomethylated that overlap the CpG site; and (4) count of vectors of the non-cancer set labeled hypermethylated that overlap the CpG site. Additionally the process may normalize these counts for each group to account for variance in group size between the non-cancer group and the cancer group.

In one embodiment, the hypomethylation score at a given CpG site is defined as a log of a ratio of (1) over (3). Similarly the hypermethylation score is calculated as a log of a ratio of (2) over (4). Additionally these ratios may be calculated with an additional smoothing technique as discussed above.

In another embodiment, the hypomethylation score is defined as a ratio of (1) over (1) summed with (3). The hypermethylation score is defined as a ratio of (2) over (2) summed with (4). Similar to the embodiment above, smoothing techniques may be implemented into the ratios.

The analytics system generates 630 an aggregate hypomethylation score and an aggregate hypermethylation score for each anomalous methylation state vector. The aggregate hyper and hypo methylation scores, are determined based on the hyper and hypo methylation scores of the CpG sites in the methylation state vector. In one embodiment, the aggregate hyper and hypo methylation scores are assigned as the largest hyper and hypo methylation scores of the sites in each state vector, respectively. However, in alternate embodiments, the aggregate scores could be based on means, medians, or other calculations that use the hyper/hypo methylation scores of the sites in each vector. In one embodiment, the analytics system assigns the greater of the aggregate hypomethylation score and the aggregate hypermethylation score to the anomalous methylation state vector.

The analytics system then ranks 640 all of that subject's methylation state vectors by their aggregate hypomethylation score and by their aggregate hypermethylation score, resulting in two rankings per subject. The process selects aggregate hypomethylation scores from the hypomethylation ranking and aggregate hypermethylation scores from the hypermethylation ranking. With the selected scores, the classifier generates 650 a single feature vector for each subject. In one embodiment, the scores selected from either ranking are selected with a fixed order that is the same for each generated feature vector for each subject in each of the training groups. As an example, in one embodiment the classifier selects the first, the second, the fourth, the eighth, the sixteenth, the thirty-second, and the sixty-fourth aggregate hyper methylation score, and similarly for each aggregate hypo methylation score, from each ranking and writes those scores in the feature vector for that subject (totaling 14 features in the feature vector). In additional embodiments, to adjust for sample sequencing depth, the analytics system adjusts ranks in linear proportion to relative sample depth. For example, if the relative sample depth was x, interpolated scores were taken at x*the original ranks (i.e. x=1.1, we take scores computed at ranks 1.1, 2.2, ..., x*2i). The analytics system may then define the feature vector based on the adjusted ranks to be used in further classification.

The analytics system trains 660 a binary classifier to distinguish feature vectors between the cancer and non-cancer training groups. The analytics system may group the training samples into sets of one or more training samples for iterative batch training of the binary classifier. After inputting all sets of training samples including their training feature vectors and adjusting the classification parameters, the binary classifier is sufficiently trained to label test samples according to their feature vector within some margin of error.

In one embodiment, the classifier is a non-linear classifier. In a specific embodiment, the classifier is a non-linear classifier utilizing a L2-regularized kernel logistic regression with a Gaussian radial basis function (RBF) kernel. Specifically, a regularized kernel logistic regression classifier (KLR) was trained using the isotropic radial basis function (power exponential 2) as the kernel with scale parameter gamma and L2 regularization parameter lambda. Gamma and lambda were optimized for holdout log-loss using internal cross-validation within specified training data, and were optimized using grid-search in multiplicative steps, starting at the maximum value and halving the parameter each step. In other embodiments, the classifier can include other types of classifiers, such as a random forest classifier, a mixture model, a convolutional neural network, or an autoencoder model.

In some embodiments, calculation is performed with respect to each CpG site. Specifically a first count is determined that is the number of cancerous samples (cancer_count) that include a fragment overlapping that CpG, and a second count is determined that is the total number of samples containing fragments overlapping that CpG (total) in the set. Genomic regions can be selected based on the numbers, for example, based on criteria positively correlated to the number of cancerous samples (cancer_count) that include a fragment overlapping that CpG, and inversely correlated to the total number of samples containing fragments overlapping that CpG (total) in the set. Specifically, in one embodiment, the number of non-cancer samples ($n_{non-cancer}$) and the number of cancer samples ($n_{cancer}$) having a fragment overlapping a CpG site are counted. Then the probability that a sample is cancer is estimated as $(n_{cancer}+1)/(n_{cancer}+n_{non-cancer}+2)$. CpG sites by this metric were ranked and greedily added to a panel until the panel size budget is exhausted.

In some cases, additional analysis calculates the log-odds ratio that the anomalous fragments from a subject are indicative of cancer generally. The log-odds ratio can be calculated by taking the log of a ratio of a probability of being cancerous over a probability of being non-cancerous (i.e., one minus the probability of being cancerous), both as determined by the applied classification model.

6.4.4. Off-Target Genomic Regions

In some embodiments, probes targeting selected genomic regions are further filtered 465 based on the number of their off-target regions. This is for screening probes that pull down too many cfDNA fragments containing off-target genomic regions. Exclusion of probes having many off-target regions can be valuable by decreasing off-target rates and increasing target coverage for a given amount of sequencing.

An off-target genomic region is a genomic region that has sufficient homology to a target genomic region to be bound and pulled down by a probe designed to target the target genomic region. An off-target genomic region can be a genomic region (or a converted sequence of that same region) that aligns to a probe along at least 35 bp, 40 bp, 45 bp, 50 bp, 60 bp, 70 bp, or 80 bp with at least an 80%, 85%, 90%, 95%, or 97% match rate. In one embodiment, an off-target genomic region is a genomic region (or a converted sequence of that same region) that aligns to a probe along at least 45 bp with at least a 90% match rate. Various methods known in the art can be adopted to screen off-target genomic regions.

Exhaustively searching the genome to find all off-target genomic regions can be computationally challenging. In one embodiment, a k-mer seeding strategy (which can allow one or more mismatches) is combined to local alignment at the seed locations. In this case, exhaustive searching of good alignments can be guaranteed based on k-mer length, number of mismatches allowed, and number of k-mer seed hits at a particular location. This requires doing dynamic programing local alignment at a large number of locations, so this approach is highly optimized to use vector CPU instructions (e.g., AVX2, AVX512) and also can be parallelized across many cores within a machine and also across many machines connected by a network. A person of ordinary skill will recognize that modifications and variations of this approach can be implemented for the purpose of identifying off-target genomic regions.

In some embodiments, probes having off-target genomic regions more than a threshold number are excluded. For example, probes having more than 30, more than 25, more than 20, more than 18, more than 15, more than 12, more than 10, or more than 5 are excluded.

In some embodiments, probes are divided into 2, 3, 4, 5, 6, or more separate groups depending on the numbers of off-target regions. For example, probes having no off-target regions are assigned to high-quality group, probes having 1-19 off-target regions are assigned to low-quality group, and probes having more than 19 off-target regions are assigned to poor-quality group. Other cut-off values can be used for the grouping.

In some embodiments, probes in the lowest quality group are excluded. In some embodiments, probes in groups other than the highest-quality group are excluded. In some embodiments, separate panels are made for the probes in each group. In some embodiments, all the probes are put on the same panel, but separate analysis is performed based on the assigned groups.

In some embodiments, a panel comprises a larger number of high-quality probes than the number of probes in lower groups. In some embodiments, a panel comprises a smaller number of poor-quality probes than the number of probes in other group. In some embodiments, more than 95%, 90%, 85%, 80%, 75%, or 70% of probes in a panel are high-quality probes. In some embodiments, less than 35%, 30%, 20%, 10%, 5%, 4%, 3%, 2% or 1% of the probes in a panel are low-quality probes. In some embodiments, less than 5%, 4%, 3%, 2% or 1% of the probes in a panel are poor-quality probes. In some embodiments, no poor-quality probes are included in a panel.

In some embodiments, probes having below 50%, below 40%, below 30%, below 20%, below 10% or below 5% are excluded. In some embodiments, probes having above 30%, above 40%, above 50%, above 60%, above 70%, above 80%, or above 90% are selectively included in a panel.

6.5. Methods of Using Cancer Assay Panel

In yet another aspect, methods of using a cancer assay panel are provided. The methods can comprise steps of bisulfite treatment cfDNA fragments to convert unmethylated cytosines to uracils, applying the samples to the cancer assay panel and sequencing cfDNA fragments that bind to the probes in the panel. The sequence reads can be further compared to a reference genome. This assay can allow identification of methylation states at CpG sites within the fragments and thus provide information relevant to diagnosis of cancer.

6.5.1. Sample Processing

Figure 7A:
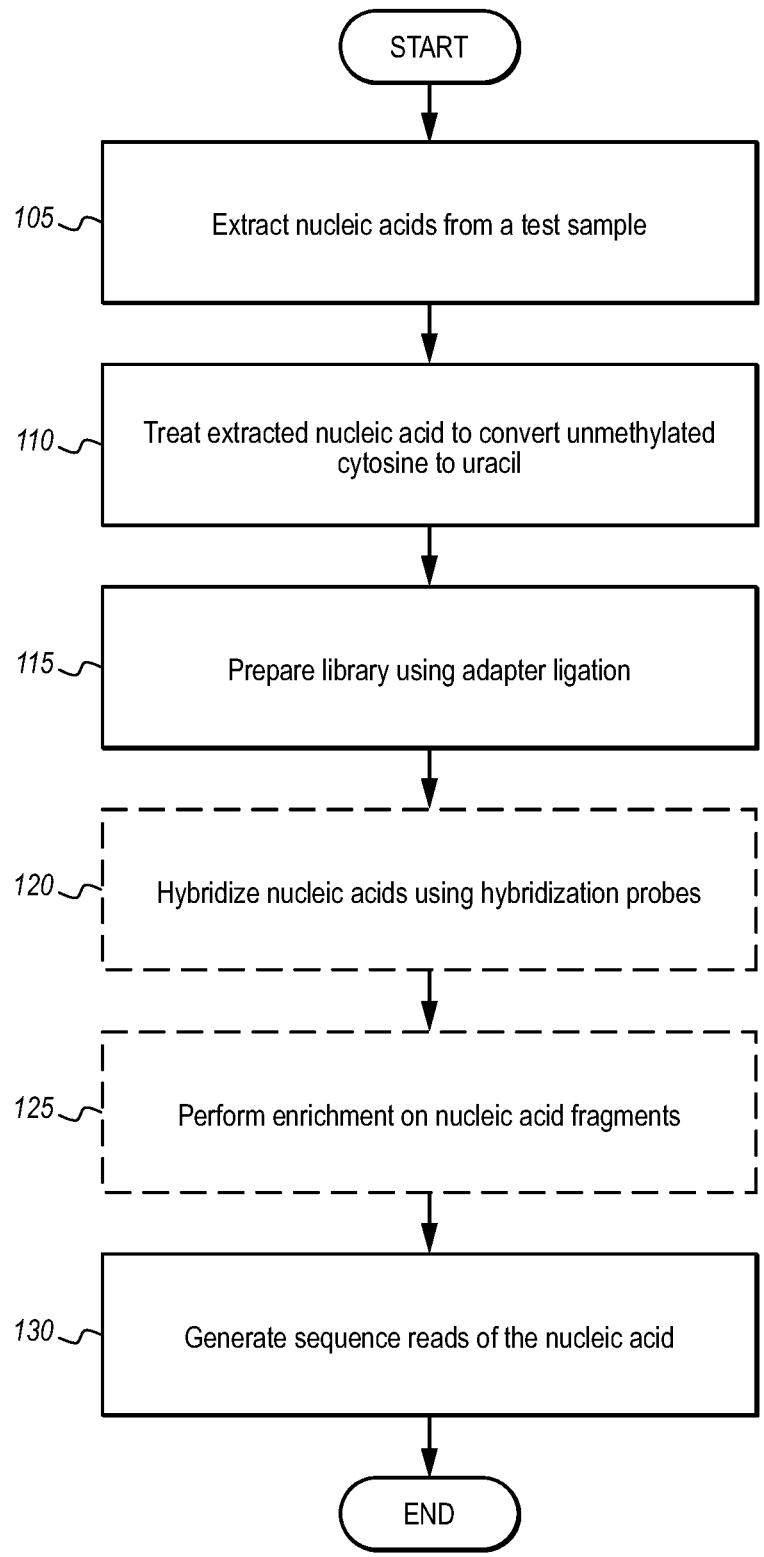
FIG. 7A is a flowchart describing a process of sequencing a fragment of cell-free DNA (cfDNA), according to an embodiment.

FIG. 7A is a flowchart of a method for preparing a nucleic acid sample for analysis according to one embodiment. The method includes, but is not limited to, the following steps. For example, any step of the method may comprise a quantitation sub-step for quality control or other laboratory assay procedures known to one skilled in the art.

In step 105, a nucleic acid sample (DNA or RNA) is extracted from a subject. In the present disclosure, DNA and RNA may be used interchangeably unless otherwise indicated. That is, the embodiments described herein may be applicable to both DNA and RNA types of nucleic acid sequences. However, the examples described herein may focus on DNA for purposes of clarity and explanation. The sample may be any subset of the human genome, including the whole genome. The sample may include blood, plasma, serum, urine, fecal, saliva, other types of bodily fluids, or any combination thereof. In some embodiments, methods for drawing a blood sample (e.g., syringe or finger prick) may be less invasive than procedures for obtaining a tissue biopsy, which may require surgery. The extracted sample may comprise cfDNA and/or ctDNA. For healthy individuals, the human body may naturally clear out cfDNA and other cellular debris. If a subject has a cancer or disease, cfDNA or ctDNA in an extracted sample may be present at a detectable level for diagnosis.

In step 110, the cfDNA fragments are treated to convert unmethylated cytosines to uracils. In one embodiment, the method uses a bisulfite treatment of the DNA which converts the unmethylated cytosines to uracils without converting the methylated cytosines. For example, a commercial kit such as the EZ DNA Methylation™—Gold, EZ DNA Methylation™—Direct or an EZ DNA Methylation™—Lightning kit (available from Zymo Research Corp (Irvine, Calif.)) is used for the bisulfite conversion. In another embodiment, the conversion of unmethylated cytosines to uracils is accomplished using an enzymatic reaction. For example, the conversion can use a commercially available kit for conversion of unmethylated cytosines to uracils, such as APOBEC-Seq (NEBiolabs, Ipswich, Mass.).

In step 115, a sequencing library is prepared. In a first step, a ssDNA adapter is added to the 3'-OH end of a bisulfite-converted ssDNA molecule using a ssDNA ligation reaction. In one embodiment, the ssDNA ligation reaction uses CircLigase II (Epicentre) to ligate the ssDNA adapter to the 3'-OH end of a bisulfite-converted ssDNA molecule, wherein the 5'-end of the adapter is phosphorylated and the bisulfite-converted ssDNA has been dephosphorylated (i.e., the 3' end has a hydroxyl group). In another embodiment, the ssDNA ligation reaction uses Thermostable 5' AppDNA/RNA ligase (available from New England BioLabs (Ipswich, Mass.)) to ligate the ssDNA adapter to the 3'-OH end of a bisulfite-converted ssDNA molecule. In this example, the first UMI adapter is adenylated at the 5'-end and blocked at the 3'-end. In another embodiment, the ssDNA ligation reaction uses a T4 RNA ligase (available from New England BioLabs) to ligate the ssDNA adapter to the 3'-OH end of a bisulfite-converted ssDNA molecule. In a second step, a second strand DNA is synthesized in an extension reaction. For example, an extension primer, that hybridizes to a primer sequence included in the ssDNA adapter, is used in a primer extension reaction to form a double-stranded bisulfate-converted DNA molecule. Optionally, in one embodiment, the extension reaction uses an enzyme that is able to read through uracil residues in the bisulfate-converted template strand. Optionally, in a third step, a dsDNA adapter is added to the double-stranded bisulfate-converted DNA molecule. Finally, the double-stranded bisulfate-converted DNA is amplified to add sequencing adapters. For example, PCR amplification using a forward primer that includes a P5 sequence and a reverse primer that includes a P7 sequence is used to add P5 and P7 sequences to the bisulfate-converted DNA. Optionally, during library preparation, unique molecular identifiers (UMI) may be added to the nucleic acid molecules (e.g., DNA molecules) through adapter ligation. The UMIs are short nucleic acid sequences (e.g., 4-10 base pairs) that are added to ends of DNA fragments during adapter ligation. In some embodiments, UMIs are degenerate base pairs that serve as a unique tag that can be used to identify sequence reads originating from a specific DNA fragment. During PCR amplification following adapter ligation, the UMIs are replicated along with the attached DNA fragment, which provides a way to identify sequence reads that came from the same original fragment in downstream analysis.

In step 120, targeted DNA sequences may be enriched from the library. This is used, for example, where a targeted panel assay is being performed on the samples. During enrichment, hybridization probes (also referred to herein as "probes") are used to target, and pull down, nucleic acid fragments informative for the presence or absence of cancer (or disease), or cancer status. For a given workflow, the probes may be designed to anneal (or hybridize) to a target (complementary) strand of DNA or RNA. The target strand may be the "positive" strand (e.g., the strand transcribed into mRNA, and subsequently translated into a protein) or the complementary "negative" strand. The probes may range in length from 10s, 100s, or 1000s of base pairs. Moreover, the probes may cover overlapping portions of a target region.

After a hybridization step 120, the hybridized nucleic acid fragments are captured and may also be amplified using PCR (enrichment 125). For example, the target sequences can be enriched to obtain enriched sequences that can be subsequently sequenced. In general, any known method in the art can be used to isolate, and enrich for, probe-hybridized target nucleic acids. For example, as is well known in the art, a biotin moiety can be added to the 5'-end of the probes (i.e., biotinylated) to facilitate isolation of target nucleic acids hybridized to probes using a streptavidin-coated surface (e.g., streptavidin-coated beads).

In step 130, sequence reads are generated from the enriched DNA sequences, e.g., enriched sequences. Sequencing data may be acquired from the enriched DNA sequences by known means in the art. For example, the method may include next generation sequencing (NGS) techniques including synthesis technology (Illumina), pyro-sequencing (454 Life Sciences), ion semiconductor technology (Ion Torrent sequencing), single-molecule real-time sequencing (Pacific Biosciences), sequencing by ligation (SOLiD sequencing), nanopore sequencing (Oxford Nanopore Technologies), or paired-end sequencing. In some embodiments, massively parallel sequencing is performed using sequencing-by-synthesis with reversible dye terminators.

6.5.2. Analysis of Sequence Reads

In some embodiments, the sequence reads may be aligned to a reference genome using known methods in the art to determine alignment position information. The alignment position information may indicate a beginning position and an end position of a region in the reference genome that corresponds to a beginning nucleotide base and end nucleotide base of a given sequence read. Alignment position information may also include sequence read length, which can be determined from the beginning position and end position. A region in the reference genome may be associated with a gene or a segment of a gene.

In various embodiments, a sequence read is comprised of a read pair denoted as $R_1$ and $R_2$. For example, the first read $R_1$ may be sequenced from a first end of a nucleic acid fragment whereas the second read $R_2$ may be sequenced from the second end of the nucleic acid fragment. Therefore, nucleotide base pairs of the first read $R_1$ and second read $R_2$ may be aligned consistently (e.g., in opposite orientations) with nucleotide bases of the reference genome. Alignment position information derived from the read pair $R_1$ and $R_2$ may include a beginning position in the reference genome that corresponds to an end of a first read (e.g., $R_1$) and an end position in the reference genome that corresponds to an end of a second read (e.g., $R_2$). In other words, the beginning position and end position in the reference genome represent the likely location within the reference genome to which the nucleic acid fragment corresponds. In one embodiment, the read pair $R_1$ and $R_2$ can be assembled into a fragment, and the fragment used for subsequent analysis and/or classification. An output file having SAM (sequence alignment map) format or BAM (binary alignment map) format may be generated and output for further analysis.

From the sequence reads, the location and methylation state for each of CpG site may be determined based on alignment to a reference genome. Further, a methylation state vector for each fragment may be generated specifying a location of the fragment in the reference genome (e.g., as specified by the position of the first CpG site in each fragment, or another similar metric), a number of CpG sites in the fragment, and the methylation state of each CpG site in the fragment whether methylated (e.g., denoted as M), unmethylated (e.g., denoted as U), or indeterminate (e.g., denoted as I). The methylation state vectors may be stored in temporary or persistent computer memory for later use and processing. Further, duplicate reads or duplicate methylation state vectors from a single subject may be removed. In an additional embodiment, it may be determined that a certain fragment has one or more CpG sites that have an indeterminate methylation status. Such fragments may be excluded from later processing or selectively included where downstream data model accounts for such indeterminate methylation statuses.

Figure 7B:
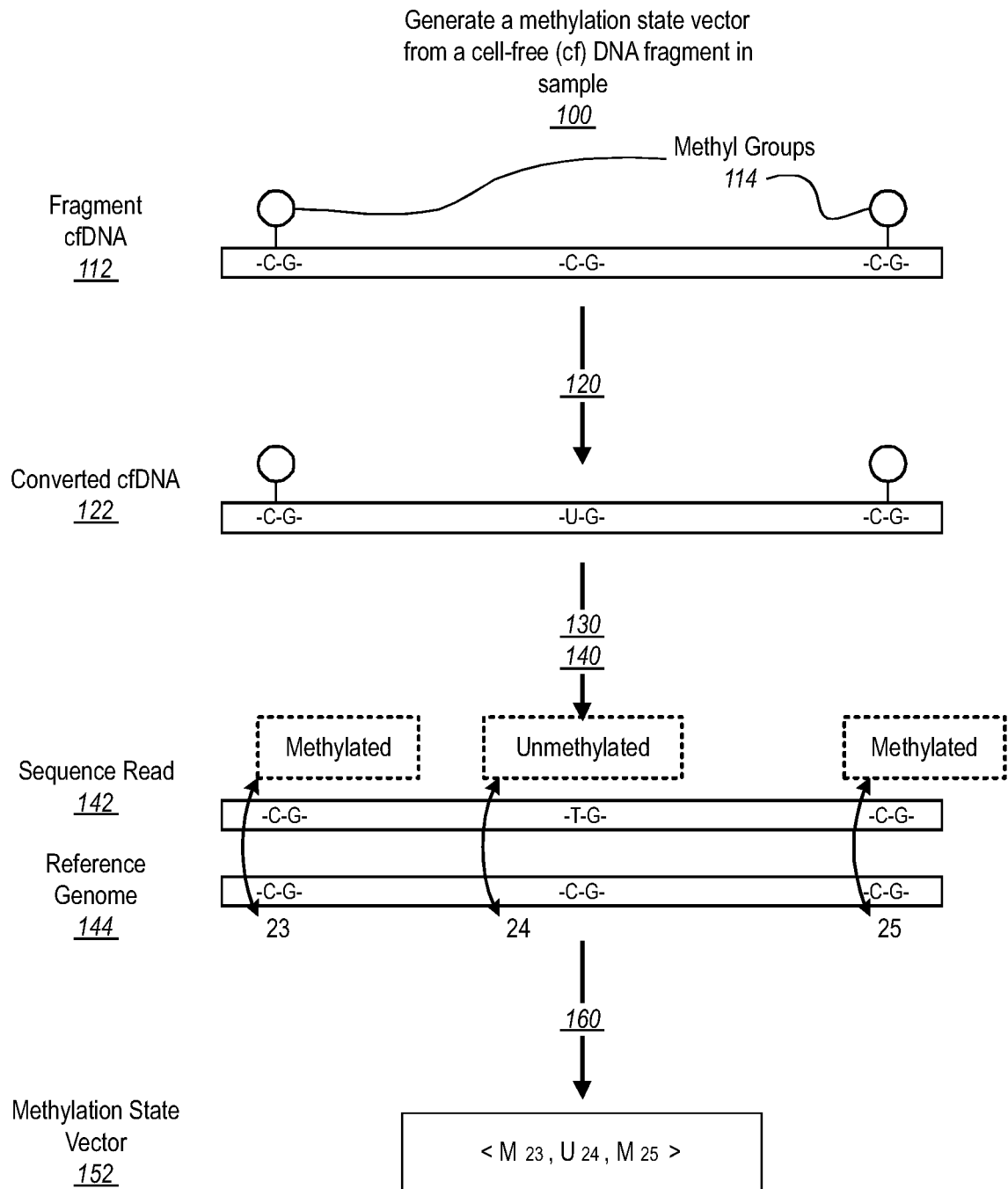
FIG. 7B is an illustration of the process of FIG. 7A of sequencing a fragment of cfDNA to obtain a methylation state vector (e.g., a methylation state for the fragment), according to an embodiment.

FIG. 7B is an illustration of the process 100 of FIG. 7A of sequencing a cfDNA fragment to obtain a methylation state vector, according to an embodiment. As an example, the analytics system takes a cfDNA fragment 112. In this example, the cfDNA fragment 112 contains three CpG sites. As shown, the first and third CpG sites of the cfDNA fragment 112 are methylated 114. During the treatment step 120, the cfDNA fragment 112 is converted to generate a converted cfDNA fragment 122. During the treatment 120, the second CpG site which was unmethylated has its cytosine converted to uracil. However, the first and third CpG sites are not converted.

After conversion, a sequencing library 130 is prepared and sequenced 140 generating a sequence read 142. The analytics system aligns 150 the sequence read 142 to a reference genome 144. The reference genome 144 provides the context as to what position in a human genome the fragment cfDNA originates from. In this simplified example, the analytics system aligns 150 the sequence read such that the three CpG sites correlate to CpG sites 23, 24, and 25 (arbitrary reference identifiers used for convenience of description). The analytics system thus generates information both on methylation status of all CpG sites on the cfDNA fragment 112 and which to position in the human genome the CpG sites map. As shown, the CpG sites on sequence read 142 which were methylated are read as cytosines. In this example, the cytosines appear in the sequence read 142 only in the first and third CpG site which allows one to infer that the first and third CpG sites in the original cfDNA fragment were methylated. Whereas, the second CpG site is read as a thymine (U is converted to T during the sequencing process), and thus, one can infer that the second CpG site was unmethylated in the original cfDNA fragment. With these two pieces of information, the methylation status and location, the analytics system generates 160 a methylation state vector 152 for the fragment cfDNA 112. In this example, the resulting methylation state vector 152 is $<M_{23}, U_{24}, M_{25}>$, wherein M corresponds to a methylated CpG site, U corresponds to an unmethylated CpG site, and the subscript number corresponds to a position of each CpG site in the reference genome.

FIGS. 9A & 9B show three graphs of data validating the consistency of sequencing from a control group. The first graph 170 shows conversion accuracy of conversion of unmethylated cytosines to uracil (step 120) on cfDNA fragment obtained from a test sample across subjects in varying stages of cancer—stage I, stage II, stage III, stage IV, and non-cancer. As shown, there was uniform consistency in converting unmethylated cytosines on cfDNA fragments into uracils. There was an overall conversion accuracy of 99.47% with a precision at ±0.024%. The second graph 180 shows mean coverage over varying stages of cancer. The mean coverage over all groups being ~34× mean across the genome coverage of DNA fragments, using only those confidently mapped to the genome are counted. The third graph 190 shows concentration of cfDNA per sample across varying stages of cancer.

6.5.3. Detection of Cancer

Sequence reads or fragments obtained by the methods provided herein can be analyzed by a medical professional, or further processed by an automated algorithms. For example, the analytics system is used to receive sequencing data from a sequencer and perform various aspects of processing as described herein. The analytics system can be one of a personal computer (PC), a desktop computer, a laptop computer, a notebook, a tablet PC, a mobile device. A computing device can be communicatively coupled to the sequencer through a wireless, wired, or a combination of wireless and wired communication technologies. Generally, the computing device is configured with a processor and memory storing computer instructions that, when executed by the processor, cause the processor to perform steps as described in the remainder of this document. Generally, the amount of genetic data and data derived therefrom is sufficiently large, and the amount of computational power required so great, so as to be impossible to be performed on paper or by the human mind alone.

The clinical interpretation of methylation status of targeted genomic regions is a process that includes classifying the clinical effect of each or a combination of the methylation status and reporting the results in ways that are meaningful to a medical professional. The clinical interpretation can be based on comparison of the sequence reads with a database specific to cancer or non-cancer subjects, and/or based on numbers and types of the cfDNA fragments having cancer-specific methylation patterns identified from a sample. In some embodiments, targeted genomic regions are ranked or classified based on their likeness to be differentially methylated in cancer samples, and the ranks or classifications are used in the interpretation process. The ranks and classifications can include (1) the type of clinical effect, (2) the strength of evidence of the effect, and (3) the size of the effect. Various methods for clinical analysis and interpretation of genome data can be adopted for analysis of the sequence reads. In some other embodiments, the clinical interpretation of the methylation states of such differentially methylated regions can be based on machine learning approaches that interpret a current sample based on a classification or regression method that was trained using the methylation states of such differentially methylated regions from samples from cancer and non-cancer patients with known cancer status, cancer type, cancer stage, tissue of origin, etc.

The clinically meaningful information can include the presence or absence of cancer generally, presence or absence of certain types of cancers, cancer stage, or presence or absence of other types of diseases. In some embodiments, the information relates to a presence or absence of one or more cancer types, selected from the group consisting of anorectal cancer, bladder and urothelial cancer, blood cancer, breast cancer (hormone receptor positive and hormone receptor negative), biliary tract cancer, cervical cancer, colorectal cancer, endometrial cancer, esophageal cancer, head and neck cancer, gastric cancer, hepatobiliary cancer, liver cancer, lung cancer, lymphoid neoplasm, gall bladder cancer, melanoma, multiple myeloma, ovarian cancer, pancreatic cancer, upper GI tract cancer, prostate cancer, renal cancer, sarcoma, thyroid cancer, bile duct cancer, urothelial cancer, and uterine cancer.

Cancer Classifier

To train a cancer type classifier, the analytics system obtains a plurality of training samples each having a set of hypomethylated and hypermethylated fragments indicative of cancer, e.g., identified via step 450 in the process 400, and a label of the training sample's cancer type. The analytics system determines, for each training sample, a feature vector based on the set of hypomethylated and hypermethylated fragments indicative of cancer. The analytics system calculates an anomaly score for each CpG site in the targeted genomic regions. In one embodiment, the analytics system defines the anomaly score for the feature vector as a binary scoring based on whether there is a hypomethylated or hypermethylated fragment from the set that encompasses the CpG site. Once all anomaly scores are determined for a training sample, the analytics system determines the feature vector as a vector of elements including, for each element, one of the anomaly scores associated with one of the CpG sites. The analytics system may normalize the anomaly scores of the feature vector based on a coverage of the sample, i.e., a median or average sequencing depth over all CpG sites.

With the feature vectors of the training samples, the analytics system can train the cancer classifier. In one embodiment, the analytics system trains a binary cancer classifier to distinguish between the labels, cancer and non-cancer, based on the feature vectors of the training samples. In this embodiment, the classifier outputs a prediction score indicating the likelihood of the presence or absence of cancer. In another embodiment, the analytics system trains a multiclass cancer classifier to distinguish between many cancer types (e.g., between head and neck cancer, liver/bileduct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer). In this multiclass cancer classifier embodiment, the cancer classifier is trained to determine a cancer prediction that comprises a prediction value for each of the cancer types being classified for. The prediction values may correspond to a likelihood that a given sample has each of the cancer types. For example, the cancer classifier returns a cancer prediction including a prediction value for breast cancer, lung cancer, and non-cancer. For example, the cancer classifier may return a cancer prediction for a test sample including a prediction score for breast cancer, lung cancer, and/or no cancer. In either embodiment, the analytics system trains the cancer classifier by inputting sets of training samples with their feature vectors into the cancer classifier and adjusting classification parameters so that a function of the classifier accurately relates the training feature vectors to their corresponding label. The analytics system may group the training samples into sets of one or more training samples for iterative batch training of the cancer classifier. After inputting all sets of training samples including their training feature vectors and adjusting the classification parameters, the cancer classifier is sufficiently trained to label test samples according to their feature vector within some margin of error. The analytics system may train the cancer classifier according to any one of a number of methods. As an example, the binary cancer classifier may be a L2-regularized logistic regression classifier that is trained using a log-loss function. As another example, the multi-cancer classifier may be a multinomial logistic regression. In practice either type of cancer classifier may be trained using other techniques. These techniques are numerous including potential use of kernel methods, machine learning algorithms such as multilayer neural networks, etc. In particular, methods as described in PCT/US2019/022122 and U.S. patent application Ser. No. 16/352,602 which are incorporated by reference in their entireties herein can be used for various embodiments.

In particular embodiments, a cancer classifier is trained by the process comprising the steps of: a. obtaining sequence information of training fragments from a plurality of training subjects; b. for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, c. for each training subject, generating a training feature vector based on the hypomethylated training fragments and hypermethylated training fragments, and d. training the model with the training feature vectors from the one or more training subjects without cancer and the training feature vectors from the one or more training subjects with cancer. The training method can further comprise the steps of: a. obtaining sequence information of training fragments from a plurality of training subjects; b. for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, c. for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; d. for each training fragment, generating an aggregate hypomethylation score based on the hypomethylation score of the CpG sites in the training fragment and an aggregate hypermethylation score based on the hypermethylation score of the CpG sites in the training fragment; e. for each training subject: ranking the plurality of training fragments based on aggregate hypomethylation score and ranking the plurality of training fragments based on aggregate hypermethylation score; and generating a feature vector based on the ranking of the training fragments; f. obtaining training feature vectors for one or more training subjects without cancer and training feature vectors for the one or more training subjects with cancer; and g. training the model with the feature vectors for the one or more training subjects without cancer and the feature vectors for the one or more training subjects with cancer. In some embodiments, the model comprises one of a kernel logistic regression classifier, a random forest classifier, a mixture model, a convolutional neural network, and an autoencoder model.

In some embodiments, quantifying a count of hypomethylated training fragments which overlap that CpG site and a count of hypermethylated training fragments which overlap that CpG site further comprises: a. quantifying a cancer count of hypomethylated training fragments from the one or more training subjects with cancer that overlap that CpG site and a non-cancer count of hypomethylated training fragments from the one or more training subjects without cancer that overlap that CpG site; and b. quantifying a cancer count of hypermethylated training fragments from the one or more training subjects with cancer that overlap that CpG site and a non-cancer count of hypermethylated training fragments from the one or more training subjects without cancer that overlap that CpG site. In some embodiments, generating a hypomethylation score and a hypermethylation score based on the count of hypomethylated training fragments and hypermethylated training fragments further comprises: a. for generating the hypomethylation score, calculating a hypomethylation ratio of the cancer count of hypomethylated training fragments over a hypomethylation sum of the cancer count of hypomethylated training fragments and the non-cancer count of hypomethylated training fragments; and b. for generating the hypermethylation score, calculating a hypermethylation ratio of the cancer count of hypermethylated training fragments over a hypermethylation sum of the cancer count of hypermethylated training fragments and the non-cancer count of hypermethylated training fragments.

During deployment, the analytics system obtains sequence reads from a test sample collected from a subject. Various sequencing methods available in the art can be used to obtain sequence reads. In some embodiments, the sequence reads are obtained from whole genome sequencing or targeted sequencing. In some embodiments, the sequence reads include a set of sequence reads of modified test fragments, wherein the modified test fragments are obtained by processing a set of nucleic acid fragments, wherein each of the nucleic acid fragments corresponds to or is derived from a plurality of genomic regions selected from any one of Lists 1-8. In some embodiments, the sequence reads are from the DNA samples enriched using the assay panel described herein.

The analytics system processes the sequence reads to obtain a test feature vector in a similar process as described for the training samples. In some embodiments, the test feature vector is obtained by the process comprising a. for each of the nucleic acid fragments, determining whether the nucleic acid fragment is hypomethylated or hypermethylated, wherein each of the hypomethylated and hypermethylated nucleic acid fragments comprises at least a threshold number of CpG sites with at least a threshold percentage of the CpG sites being unmethylated or methylated, respectively; b. for each of a plurality of CpG sites in a reference genome: quantifying a count of hypomethylated nucleic acid fragments which overlap the CpG site and a count of hypermethylated nucleic acid fragments which overlap the CpG site; and generating a hypomethylation score and a hypermethylation score based on the count of hypomethylated nucleic acid fragments and hypermethylated nucleic acid fragments; c. for each nucleic acid fragment, generating an aggregate hypomethylation score based on the hypomethylation score of the CpG sites in the nucleic acid fragment and an aggregate hypermethylation score based on the hypermethylation score of the CpG sites in the nucleic acid fragment; d. ranking the plurality of nucleic acid fragments based on aggregate hypomethylation score and ranking the plurality of nucleic fragments based on aggregate hypermethylation score; and e. generating the test feature vector based on the ranking of the nucleic acid fragments.

The analytics system then inputs the test feature vector into the trained cancer classifier to yield a cancer prediction, e.g., binary prediction (cancer or non-cancer) or multiclass cancer prediction (prediction score for each of a plurality of cancer types). In some embodiments, the analytics system outputs a cancer probability for the test sample. The cancer probability can be compared to a threshold probability to determine whether the test sample is from a subject with cancer or without cancer.

Exemplary Sequencer and Analytics System

FIG. 8A is a flowchart of systems and devices for sequencing nucleic acid samples according to one embodiment. This illustrative flowchart includes devices such as a sequencer 820 and an analytics system 800. The sequencer 820 and the analytics system 800 may work in tandem to perform one or more steps in the processes described herein.

In various embodiments, the sequencer 820 receives an enriched nucleic acid sample 810. As shown in FIG. 8A, the sequencer 820 can include a graphical user interface 825 that enables user interactions with particular tasks (e.g., initiate sequencing or terminate sequencing) as well as one more loading stations 830 for loading a sequencing cartridge including the enriched fragment samples and/or for loading necessary buffers for performing the sequencing assays. Therefore, once a user of the sequencer 820 has provided the necessary reagents and sequencing cartridge to the loading station 830 of the sequencer 820, the user can initiate sequencing by interacting with the graphical user interface 825 of the sequencer 820. Once initiated, the sequencer 820 performs the sequencing and outputs the sequence reads of the enriched fragments from the nucleic acid sample 810.

In some embodiments, the sequencer 820 is communicatively coupled with the analytics system 800. The analytics system 800 includes some number of computing devices used for processing the sequence reads for various applications such as assessing methylation status at one or more CpG sites, variant calling or quality control. The sequencer 820 may provide the sequence reads in a BAM file format to the analytics system 800. The analytics system 800 can be communicatively coupled to the sequencer 820 through a wireless, wired, or a combination of wireless and wired communication technologies. Generally, the analytics system 800 is configured with a processor and non-transitory computer-readable storage medium storing computer instructions that, when executed by the processor, cause the processor to process the sequence reads or to perform one or more steps of any of the methods or processes disclosed herein.

In some embodiments, the sequence reads may be aligned to a reference genome using known methods in the art to determine alignment position information, e.g., part of step 140 of the process 100 in FIG. 3A. Alignment position may generally describe a beginning position and an end position of a region in the reference genome that corresponds to a beginning nucleotide based and an end nucleotide base of a given sequence read. Corresponding to methylation sequencing, the alignment position information may be generalized to indicate a first CpG site and a last CpG site included in the sequence read according to the alignment to the reference genome. The alignment position information may further indicate methylation statuses and locations of all CpG sites in a given sequence read. A region in the reference genome may be associated with a gene or a segment of a gene; as such, the analytics system 800 may label a sequence read with one or more genes that align to the sequence read. In one embodiment, fragment length (or size) is determined from the beginning and end positions.

In various embodiments, for example when a paired-end sequencing process is used, a sequence read is comprised of a read pair denoted as R_1 and R_2. For example, the first read R_1 may be sequenced from a first end of a double-stranded DNA (dsDNA) molecule whereas the second read R_2 may be sequenced from the second end of the double-stranded DNA (dsDNA). Therefore, nucleotide base pairs of the first read R_1 and second read R_2 may be aligned consistently (e.g., in opposite orientations) with nucleotide bases of the reference genome. Alignment position information derived from the read pair R_1 and R_2 may include a beginning position in the reference genome that corresponds to an end of a first read (e.g., R_1) and an end position in the reference genome that corresponds to an end of a second read (e.g., R_2). In other words, the beginning position and end position in the reference genome represent the likely location within the reference genome to which the nucleic acid fragment corresponds. In one embodiment, the read pair $R_1$ and $R_2$ can be assembled into a fragment, and the fragment used for subsequent analysis and/or classification. An output file having SAM (sequence alignment map) format or BAM (binary) format may be generated and output for further analysis.

Referring now to FIG. 8B, FIG. 8B is a block diagram of an analytics system 800 for processing DNA samples according to one embodiment. The analytics system implements one or more computing devices for use in analyzing DNA samples. The analytics system 800 includes a sequence processor 840, sequence database 845, model database 855, models 850, parameter database 865, and score engine 860. In some embodiments, the analytics system 800 performs one or more steps in the processes 100 of FIG. 3A, 340 of FIG. 3B, 400 of FIG. 4, 500 of FIG. 5, 600 of FIG. 6A, or 680 of FIG. 6B and other process described herein.

The sequence processor 840 generates methylation state vectors for fragments from a sample. At each CpG site on a fragment, the sequence processor 840 generates a methylation state vector for each fragment specifying a location of the fragment in the reference genome, a number of CpG sites in the fragment, and the methylation state of each CpG site in the fragment whether methylated, unmethylated, or indeterminate via the process 100 of FIG. 3A. The sequence processor 840 may store methylation state vectors for fragments in the sequence database 845. Data in the sequence database 845 may be organized such that the methylation state vectors from a sample are associated to one another.

Further, multiple different models 850 may be stored in the model database 855 or retrieved for use with test samples. In one example, a model is a trained cancer classifier for determining a cancer prediction for a test sample using a feature vector derived from anomalous fragments. The training and use of the cancer classifier is discussed elsewhere herein. The analytics system 800 may train the one or more models 850 and store various trained parameters in the parameter database 865. The analytics system 800 stores the models 850 along with functions in the model database 855.

During inference, the score engine 860 uses the one or more models 850 to return outputs. The score engine 860 accesses the models 850 in the model database 855 along with trained parameters from the parameter database 865. According to each model, the score engine receives an appropriate input for the model and calculates an output based on the received input, the parameters, and a function of each model relating the input and the output. In some use cases, the score engine 860 further calculates metrics correlating to a confidence in the calculated outputs from the model. In other use cases, the score engine 860 calculates other intermediary values for use in the model.

Application

In some embodiments, the methods, analytic systems and/or classifier of the present invention can be used to detect the presence (or absence) of cancer, monitor cancer progression or recurrence, monitor therapeutic response or effectiveness, determine a presence or monitor minimum residual disease (MRD), or any combination thereof. In some embodiments, the analytic systems and/or classifier may be used to identify the tissue or origin for a cancer. For instance, the systems and/or classifiers may be used to identify a cancer as of any of the following cancer types: head and neck cancer, liver/bileduct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. For example, as described herein, a classifier can be used to generate a likelihood or probability score (e.g., from 0 to 100) that a sample feature vector is from a subject with cancer. In some embodiments, the probability score is compared to a threshold probability to determine whether or not the subject has cancer. In other embodiments, the likelihood or probability score can be assessed at different time points (e.g., before or after treatment) to monitor disease progression or to monitor treatment effectiveness (e.g., therapeutic efficacy). In still other embodiments, the likelihood or probability score can be used to make or influence a clinical decision (e.g., diagnosis of cancer, treatment selection, assessment of treatment effectiveness, etc.). For example, in one embodiment, if the likelihood or probability score exceeds a threshold, a physician can prescribe an appropriate treatment.

Early Detection of Cancer

In some embodiments, the methods and/or classifier of the present invention are used to detect the presence or absence of cancer in a subject suspected of having cancer. For example, a classifier (as described herein) can be used to determine a likelihood or probability score that a sample feature vector is from a subject that has cancer.

In one embodiment, a probability score of greater than or equal to 60 can indicated that the subject has cancer. In still other embodiments, a probability score greater than or equal to 65, greater than or equal to 70, greater than or equal to 75, greater than or equal to 80, greater than or equal to 85, greater than or equal to 90, or greater than or equal to 95, indicated that the subject has cancer. In other embodiments, a probability score can indicate the severity of disease. For example, a probability score of 80 may indicate a more severe form, or later stage, of cancer compared to a score below 80 (e.g., a score of 70). Similarly, an increase in the probability score over time (e.g., at a second, later time point) can indicate disease progression or a decrease in the probability score over time (e.g., at a second, later time point) can indicate successful treatment.

In another embodiment, a cancer log-odds ratio can be calculated for a test subject by taking the log of a ratio of a probability of being cancerous over a probability of being non-cancerous (i.e., one minus the probability of being cancerous), as described herein. In accordance with this embodiment, a cancer log-odds ratio greater than 1 can indicate that the subject has cancer. In still other embodiments, a cancer log-odds ratio greater than 1.2, greater than 1.3, greater than 1.4, greater than 1.5, greater than 1.7, greater than 2, greater than 2.5, greater than 3, greater than 3.5, or greater than 4, indicated that the subject has cancer. In other embodiments, a cancer log-odds ratio can indicate the severity of disease. For example, a cancer log-odds ratio greater than 2 may indicate a more severe form, or later stage, of cancer compared to a score below 2 (e.g., a score of 1). Similarly, an increase in the cancer log-odds ratio over time (e.g., at a second, later time point) can indicate disease progression or a decrease in the cancer log-odds ratio over time (e.g., at a second, later time point) can indicate successful treatment.

According to aspects of the present invention, the methods and systems of the present invention can be trained to detect or classify multiple cancer indications. For example, the methods, systems and classifiers of the present invention can be used to detect the presence of one or more, two or more, three or more, five or more, or ten or more different types of cancer.

In some embodiments, the cancer is one or more of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In some embodiments, the cancer is one or more of anorectal cancer, bladder or urothelial cancer, or cervical cancer.

Cancer and Treatment Monitoring

In some embodiments, the likelihood or probability score can be assessed at different time points (e.g., or before or after treatment) to monitor disease progression or to monitor treatment effectiveness (e.g., therapeutic efficacy). For example, the present disclosure provides methods that involve obtaining a first sample (e.g., a first plasma cfDNA sample) from a cancer patient at a first time point, determining a first likelihood or probability score therefrom (as described herein), obtaining a second test sample (e.g., a second plasma cfDNA sample) from the cancer patient at a second time point, and determine a second likelihood or probability score therefrom (as described herein).

In certain embodiments, the first time point is before a cancer treatment (e.g., before a resection surgery or a therapeutic intervention), and the second time point is after a cancer treatment (e.g., after a resection surgery or therapeutic intervention), and the method utilized to monitor the effectiveness of the treatment. For example, if the second likelihood or probability score decreases compared to the first likelihood or probability score, then the treatment is considered to have been successful. However, if the second likelihood or probability score increases compared to the first likelihood or probability score, then the treatment is considered to have not been successful. In other embodiments, both the first and second time points are before a cancer treatment (e.g., before a resection surgery or a therapeutic intervention). In still other embodiments, both the first and the second time points are after a cancer treatment (e.g., before a resection surgery or a therapeutic intervention) and the method is used to monitor the effectiveness of the treatment or loss of effectiveness of the treatment. In still other embodiments, cfDNA samples may be obtained from a cancer patient at a first and second time point and analyzed. e.g., to monitor cancer progression, to determine if a cancer is in remission (e.g., after treatment), to monitor or detect residual disease or recurrence of disease, or to monitor treatment (e.g., therapeutic) efficacy.

Those of skill in the art will readily appreciate that test samples can be obtained from a cancer patient over any desired set of time points and analyzed in accordance with the methods of the invention to monitor a cancer state in the patient. In some embodiments, the first and second time points are separated by an amount of time that ranges from about 15 minutes up to about 30 years, such as about 30 minutes, such as about 1, 2, 3, 4, 5, 6, 7, 8, 9, 10, 11, 12, 13, 14, 15, 16, 17, 18, 19, 20, 21, 22, 23, or about 24 hours, such as about 1, 2, 3, 4, 5, 10, 15, 20, 25 or about 30 days, or such as about 1, 2, 3, 4, 5, 6, 7, 8, 9, 10, 11, or 12 months, or such as about 1, 1.5, 2, 2.5, 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5 or about 30 years. In other embodiments, test samples can be obtained from the patient at least once every 3 months, at least once every 6 months, at least once a year, at least once every 2 years, at least once every 3 years, at least once every 4 years, or at least once every 5 years.

Treatment

In still another embodiment, information obtained from any method described herein (e.g., the likelihood or probability score) can be used to make or influence a clinical decision (e.g., diagnosis of cancer, treatment selection, assessment of treatment effectiveness, etc.). For example, in one embodiment, if the likelihood or probability score exceeds a threshold, a physician can prescribe an appropriate treatment (e.g., a resection surgery, radiation therapy, chemotherapy, and/or immunotherapy). In some embodiments, information such as a likelihood or probability score can be provided as a readout to a physician or subject.

A classifier (as described herein) can be used to determine a likelihood or probability score that a sample feature vector is from a subject that has cancer. In one embodiment, an appropriate treatment (e.g., resection surgery or therapeutic) is prescribed when the likelihood or probability exceeds a threshold. For example, in one embodiment, if the likelihood or probability score is greater than or equal to 60, one or more appropriate treatments are prescribed. In another embodiments, if the likelihood or probability score is greater than or equal to 65, greater than or equal to 70, greater than or equal to 75, greater than or equal to 80, greater than or equal to 85, greater than or equal to 90, or greater than or equal to 95, one or more appropriate treatments are prescribed. In other embodiments, a cancer log-odds ratio can indicate the effectiveness of a cancer treatment. For example, an increase in the cancer log-odds ratio over time (e.g., at a second, after treatment) can indicate that the treatment was not effective. Similarly, a decrease in the cancer log-odds ratio over time (e.g., at a second, after treatment) can indicate successful treatment. In another embodiment, if the cancer log-odds ratio is greater than 1, greater than 1.5, greater than 2, greater than 2.5, greater than 3, greater than 3.5, or greater than 4, one or more appropriate treatments are prescribed.

In some embodiments, the treatment is one or more cancer therapeutic agents selected from the group consisting of a chemotherapy agent, a targeted cancer therapy agent, a differentiating therapy agent, a hormone therapy agent, and an immunotherapy agent. For example, the treatment can be one or more chemotherapy agents selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, platinum-based agents and any combination thereof. In some embodiments, the treatment is one or more targeted cancer therapy agents selected from the group consisting of signal transduction inhibitors (e.g. tyrosine kinase and growth factor receptor inhibitors), histone deacetylase (HDAC) inhibitors, retinoic receptor agonists, proteosome inhibitors, angiogenesis inhibitors, and monoclonal antibody conjugates. In some embodiments, the treatment is one or more differentiating therapy agents including retinoids, such as tretinoin, alitretinoin and bexarotene. In some embodiments, the treatment is one or more hormone therapy agents selected from the group consisting of anti-estrogens, aromatase inhibitors, progestins, estrogens, anti-androgens, and GnRH agonists or analogs. In one embodiment, the treatment is one or more immunotherapy agents selected from the group comprising monoclonal antibody therapies such as rituximab (RITUXAN) and alemtuzumab (CAMPATH), non-specific immunotherapies and adjuvants, such as BCG, interleukin-2 (IL-2), and interferon-alfa, immunomodulating drugs, for instance, thalidomide and lenalidomide (REVLIMID). It is within the capabilities of a skilled physician or oncologist to select an appropriate cancer therapeutic agent based on characteristics such as the type of tumor, cancer stage, previous exposure to cancer treatment or therapeutic agent, and other characteristics of the cancer.

6.6. Examples

The following examples are put forth so as to provide those of ordinary skill in the art with a complete disclosure and description of how to make and use the present description, and are not intended to limit the scope of what the inventors regard as their description nor are they intended to represent that the experiments below are all or the only experiments performed. Efforts have been made to ensure accuracy with respect to numbers used (e.g., amounts, temperature, etc.) but some experimental errors and deviations should be accounted for.

6.6.1. Example 1: Sequencing cfDNA from Individuals with Cancer and Non-Cancer Controls The Circulating Cell-free Genome Atlas Study ("CCGA"; Clinical Trial.gov identifier NCT02889978) is a prospective, multi-center, case-control, observational study with longitudinal follow-up. De-identified biospecimens were collected from approximately 15,000 participants from 142 sites. Samples were selected to ensure a prespecified distribution of cancer types and non-cancers across sites in each cohort, and cancer and non-cancer samples were frequency age-matched by gender. The STRIVE study is a prospective, multi-center, observational cohort study designed to validate an assay for the early detection of breast cancer and other invasive cancers (See Clinical Trail.gov Identifier: NCT03085888 (clinicaltrials.gov/ct2/show/NCT03085888)). As described below, additional non-cancer samples were selected from the STRIVE study and used for classifier training.

In some embodiments, whole-genome bisulfite sequencing (WGBS; 30× depth) of cfDNA isolated from plasma from the CCGA study subjects was employed for analysis of cfDNA. In other embodiments, as indicated below, a targeted bisulfite sequencing procedure was used for analysis of sample. Under the targeted bisulfite sequencing procedure, a probe set was used to enrich cfDNA molecules derived from a plurality of target genomic regions. For both processes, cfDNA was extracted from two tubes of plasma (up to a combined volume of 10 ml) per patient using a modified QIAamp Circulating Nucleic Acid kit (Qiagen; Germantown, Md.). Up to 75 ng of plasma cfDNA was subjected to bisulfite conversion using the EZ-96 DNA Methylation Kit (Zymo Research, D5003). Converted cfDNA was used to prepare dual indexed sequencing libraries using Accel-NGS Methyl-Seq DNA library preparation kits (Swift BioSciences; Ann Arbor, Mich.). The constructed libraries were quantified using the KAPA Library Quantification Kit for Illumina Platforms (Kapa Biosystems; Wilmington, Mass.). Four libraries along with 10% PhiX v3 library (Illumina, FC-110-3001) were pooled and clustered on an Illumina NovaSeq 6000 S2 flow cell followed by 150-bp paired-end sequencing (30×).

6.6.2. Example 2: Modeling the Methylation Status of Healthy Individuals

A statistical model and a data structure of typical cfDNA fragments were produced using an independent reference set of 108 non-smoking participants without cancer (age: 58±14 years, 79 [73%] women) (i.e., a reference genome) from the CCGA study. These samples were used to train a Markov-chain model (order 3) estimating the likelihood of a given sequence of CpG methylation statuses within a fragment as further described above in Section 6.4.2.1—P-Value Score Calculation. This model was demonstrated to be calibrated within the normal fragment range (p-value>0.001) and was used to reject fragments with a p-value from the Markov model of ≥0.001 as insufficiently unusual.

6.6.3. Example 3: Selection of Target Genomic Regions

Target genomic regions were selected using a database generated by sequencing bisulfite converted cfDNA fragments obtained from 1548 individuals who had been diagnosed with cancer and 1163 individuals who had not been diagnosed with cancer from the CCGA study.

The process for selecting target genomic regions began by identifying anomalous cfDNA fragments from among the bisulfite converted cfDNA fragment sequences from each individual. The fragments were aligned to the hg19 reference genome, and each CpG site within each fragment was scored as methylated or unmethylated, or indeterminate. Anomalous cfDNA fragments have three characteristics: (1) a bisulfite converted methylation pattern with a p-value of <0.001 according to the Markov-chain model, indicating that the methylation pattern would not be expected to occur in individuals without cancer; (2) five or more CpG sites; and (3) a hypermethylated or hypomethylated state wherein at least 80%, 90%, or 100% of the CpG sites are either methylated or unmethylated, respectively. Indeterminant sites were included in the total number of CpG sites when calculating the percentage of methylated or unmethylated CpG sites.

The second step in target selection was to determine a ranking score for each of the approximately 30 million CpG sites in the GRCh37/hg19 reference genome. For each CpG site, a count was made of cancer and non-cancer samples having at least one anomalous cfDNA fragment overlapping the CpG site. Hypermethylated anomalous fragments and hypermethylated anomalous fragments were counted separately. These counts were used to separately calculate scores for hypermethylated and hypomethylated fragments according to the following formula: $(n_{cancer}+1)/(n_{cancer}+n_{non-cancer}+2)$. Three pairs of scores were calculated for each CpG: a first pair for anomalous fragments having an 80% or more hypermethylation or hypomethylation state; a second pair for anomalous fragments having a 90% or more hypermethylation or hypomethylation state; and a third pair for anomalous fragments having a 100% hypermethylation or hypomethylation state. The highest of these six scores became the ranking score for the CpG site.

The third step in target selection was to define targeted regions within the genome. The first region added to the target list was a 30-base region extending 15 bases on either side of the center of the highest ranking CpG site. The list of target regions was then expanded in an iterative process. A 30-base region extending 15 bases on either side of the center of the next highest ranking CpG site was identified. If the new region was within 200 bases of an existing target site, the new region was merged with the existing one to form a larger region including the all bases between the new 30-base region and the old one. If the new region was not within 200 bases of an existing target site, it was simply added to the list of target regions. The list of target regions was iteratively expanded until it reached the desired panel size of 0.59 MB for Assay Panel 1, 1.19 MB for Assay Panel 2, 2.38 MB for Assay Panel 3, 4.96 MB for Assay Panel 4, and 8.53 MB for Assay Panel 5.

6.6.4. Example 4: Probe Design

Biotinylated probes were designed for the purpose of collecting bisulfite-converted anomalous cfDNA fragments that are derived from the genomic regions identified above. Each probe was 120 bases long and had a biotin moiety at its 5' end. Generally, probe sets were designed to include probes that target fragments from each of the CpG sites included within the start/stop ranges of any of the targeted regions included in any one of Lists 1-8.

To increase the probability of capturing anomalous cfDNA fragments derived from a target region (or a portion of a target region), including anomalous cfDNA fragments with partial target sequences at their 5' or 3' ends, probes were arranged in a tiled fashion so that two probes aligned to each base within a target region. Adjacent 120-base probes were designed to overlap by 60 bases. Target regions of 60 or fewer bases were initially targeted by three probes as illustrated in FIG. 1A. Additional probes were used for target regions of larger size (see e.g., FIG. 1B). For both size classes of target regions, the probes used to interrogate each region collectively extend beyond the target region (e.g., to include at least 60 bases of non-targeted sequence on either side of the target region due to the tiled arrangement; see FIG. 1A). Additionally, probes were designed to enrich DNA molecules derived from both strands of DNA from each target region, such that a single base pair of a target genomic region may be targeted by four probes: two for each strand.

Probe sequences were designed to be complementary to bisulfite-converted anomalous cfDNA fragments from each of the genomic regions, where every CpG site in a cfDNA fragment is either methylated or unmethylated. Thus, if the anomalous cfDNA fragments aligning with a target sequence are hypomethylated, all, or most of the CpG sites within the fragment would be expected to be converted to UpG sequences, and the corresponding probes would have CpA sequences for all, or most of the CpGs in the target. Conversely, if the anomalous cfDNA sequences aligning with a target sequence are hypermethylated, all, or most of the CpG sites within the fragment would be expected to be protected from conversion to UpG sequences, and the corresponding probes would have CpG sequences for all, or most of the CpGs in the target. Cytosines not located within a CpG site are generally not methylated. These bystander cytosines are therefore converted to uracil regardless of the methylation status of adjacent CpG sites. Probes matching a target site were designed to pull down hypomethylated cfDNA fragments or hypermethylated cfDNA fragments, but generally not both. This "semibinary" design contrasts with a "binary" design where cfDNA fragments from the same target region are targeted with two sets of probes, one designed to pull down hypomethylated cfDNA and the other designed to pull down hypermethylated cfDNA at the same region.

6.6.5. Example 5: Probe Quality Control

Poor quality probes likely to pull down a significant number off-target cfDNA fragments were excluded from the cancer assay panels.

To determine the characteristics of a poor-quality probe, an experiment was conducted to test how much overlap between a cfDNA fragment and a probe is required to achieve a non-negligible amount of pulldown.

Purified, bisulfite converted cfDNA was mixed with biotinylated probes in Hybridization Capture Buffer (Argonaut Technologies, Redwood City, Calif., Cat #310450) supplemented with 1 mM Tris, pH 8.0 in a 96-well plate, and processed in a Hamilton Star Liquid Handler (Hamilton, Reno, Nev., Cat #STAR AL 8/96 iSWAP) and a 96-well BioRad C1000 Touch Thermocycler (BiRad, Hercules, Calif., Cat #1851196). The temperature of the hybridization mix was raised to 95° C. for 10 minutes, and then gradually decreased by 2° C./min to 62° C., with 1-minute pauses at 93° C. and 91° C. Hybridization continued for 15.5-17.5 hours at 62° C. A second aliquot of probes was added, and the thermal cycling program was repeated. Captured cfDNA was captured on Streptavidin Magnetic Beads (Illumina, San Diego, Calif., Cat #20014367), amplified by PCR, and then sequenced.

Various overlap lengths were tested using preliminary assay panels (V1D3, V1D4, V1E2) designed to include probes having various overlaps ranging from 0 to 120 bases. Samples comprising 175 bp target DNA fragments were applied to the panel and washed, and then DNA fragments bound to the probes were collected. The amounts of the collected DNA fragments were measured, and then plotted as densities over the sizes of overlaps as provided in FIG. 10.

There was no significant binding and pull down of target DNA fragments when the overlap was less than 45 bp. These results indicate that, with the specified hybridization conditions, a fragment-probe overlap of at least 45 bp is generally required to maximize hybridization between the probe set and nucleic acids derived from the target genomic regions, and thus improve pulldown efficiency.

Furthermore, binding, and thus pulldown efficiency, is greatly disrupted when the percentage of mismatches between the probe and fragment sequences in the region of overlap is greater than 10%. It was therefore concluded that off-target pulldown may occur for probes having a sequence with a match rate of at least 90% to an off-target genomic region of at least 45 bp.

For each probe, we performed an exhaustive, bisulfate aware search of the entire reference genome for off-target regions having 45 bp alignments with a 90%+ match rate. Specifically, we combined a k-mer seeding strategy (which can allow one or more mismatches) with local alignment at the seed locations. This guaranteed against missing any good alignments based on k-mer length, number of mismatches allowed, and number of k-mer seed hits at a particular location. The search involved performing dynamic programming local alignment at a large number of locations, so the implementation was optimized to use vector CPU instructions (e.g., AVX2, AVX512) and parallelized across many cores within a machine and also across many machines connected by a network. This implementation allows for an exhaustive search, which is valuable in designing a high-performance panel (i.e., low off-target rate and high target coverage for a given amount of sequencing).

Following the exhaustive search, each probe was scored based on its number of off-target regions. The best probes (high) have a score of 1, meaning they match only one genomic region—the target. Probes with an intermediate score of between 2-19 hits (intermediate) were accepted but probes with a poor score of 20 or more hits (poor) were discarded. Table 1 presents a summary of the probes in Assay Panels 3-5, including the numbers and percentages of probes retained after eliminating low quality probes with potential off-target effects. The probe region is larger than the target region because some probes extend beyond the ends of target regions.

TABLE 1

Probe numbers and target region sizes before and after probe quality control

|  | Original probes | Final probes | Final probe target (MB) | Final target region (Mb) | Fraction of original target |
|---|---|---|---|---|---|
| Assay Panel 3 | 127,734 | 102,013 | 3.798 | 2.12 | 88.1% |
| Assay Panel 4 | 256,988 | 189,155 | 7.013 | 4.15 | 83.5% |
| Assay Panel 5 | 449,088 | 303,262 | 11.35 | 6.71 | 78.5% |

Additionally, numbers of high quality, intermediate quality, and poor-quality probes were counted among probes targeting hypermethylated genomic regions or hypomethylated genomic regions. As shown in FIG. 11, probes targeting hypermethylated genomic regions tend to have significantly less off-target matches.

6.6.6. Example 4: Characterization of Target Genomic Regions

Lists 1 to 8 (see Table 2 below) present Assay Panels of various sizes representing the portion of targeted genomic regions for which probes were designed to enrich DNA molecules derived from these targeted genomic regions. Assay Panels 1-5 are arranged from small to large according to the size budget used to select their target genomic regions. These Assay Panels were filtered to exclude certain CpG sites and genomic regions. Assay Panel 6, which defines a larger genomic region than any of Assay Panels 1-5, includes all of the CpG sites and genomic regions that were filtered out to produce each of Assay Panels 1-5. Assay Panels 3A and 4A present subsets of the target genomic regions in Assay Panels 3 and 4, respectively, excluding genomic regions that are also described in PCT/US2019/025358.

TABLE 2

Correspondence between Assay Panels, Lists, and SEQ ID NOs

| Name | List | SEQ ID NO range |
|---|---|---|
| Assay Panel 1 | List 1 | 1-1644 |
| Assay Panel 2 | List 2 | 1645-5270 |
| Assay Panel 3 | List 3 | 5271-16837 |
| Assay Panel 3A | List 4 | 16838-25984 |
| Assay Panel 4 | List 5 | 25985-46929 |
| Assay Panel 4A | List 6 | 46930-67335 |
| Assay Panel 5 | List 7 | 67336-101617 |
| Assay Panel 6 | List 8 | 101618-131822 |

The sequence listing includes the following information: (1) SEQ ID NO, (2) a sequence identifier that identifies (a) a chromosome or contig on which the CpG site is located and (b) a start and stop position of the region, (3) the sequence corresponding to (2) and (4) whether the region was included based on its hypermethylation or hypomethylation score. The chromosome numbers and the start and stop positions are provided relative to a known human reference genome, GRCh37/hg19. The sequence of GRCh37/hg19 is available from the National Center for Biotechnology Information (NCBI), the Genome Reference Consortium, and the Genome Browser provided by Santa Cruz Genomics Institute.

Generally, a probe can be designed to target any of the CpG sites included within the start/stop ranges of any of the targeted regions included in Lists 1-8. Alternatively stated, in some embodiments, probes can be designed to hybridize to any CpG site in fragments derived from any of the targeted regions, such as converted fragments from the target region.

The Assay Panels were analyzed to understand their features. The sizes of target genomic regions of the Assay Panels, prior to filtering out off-target probes, are shown in Table 10. The number of CpG sites per target genomic region, for each of various assay panels (prior to filtering out off-target probes), is plotted in FIG. 12A as a function of density. The per probe G/C content of various assay panels is presented in FIG. 12.B.

TABLE 10

Target genomic region sizes

| Region size | Assay Panel 1 | Assay Panel 2 | Assay Panel 3 | Assay Panel 4 | Assay Panel 6 |
|---|---|---|---|---|---|
| Smallest | 15 | 15 | 15 | 15 | 15 |
| Median | — | — | 95 | 94 | 82 |
| Mean | — | — | 207 | 229 | 220 |
| Largest | 2593 | 3374 | 3374 | 4368 | 6820 |

Target genomic regions within the Assay Panels were next aligned to a reference genome to evaluate their locations. Target genomic regions were positioned in introns, exons, intergenic regions, 5'UTRs, 3'UTRs, or controlling regions such as promoters or enhancers. The number of target genomic regions that fall within each genomic annotation for Assay Panels 3-5 were counted and plotted in the graphs provided in FIG. 13. FIG. 13 also compares numbers of the selected target genomic regions (black bars) with numbers of randomly selected genomic regions (gray bars) that fall within each genomic annotation.

The analysis shows that the selected target genomic regions are not random in their genomic distributions. Functional elements such as promoters, 5'UTRs, exons, and intron/exon boundaries were more highly represented in the assay panels compared to randomly selected regions, while intergenic regions were underrepresented.

6.6.7. Example 7: Generation of a Mixture Model Classifier

To maximize performance, the predictive cancer models described in this Example were trained using sequence data obtained from a plurality of samples from known cancer types and non-cancers from both CCGA sub-studies (CCGA1 and CCGA22), a plurality of tissue samples for known cancers obtained from CCGA1, and a plurality of non-cancer samples from the STRIVE study (See Clinical Trail.gov Identifier: NCT03085888 (//clinicaltrials.gov/ct2/show/NCT03085888)). The STRIVE study is a prospective, multi-center, observational cohort study to validate an assay for the early detection of breast cancer and other invasive cancers, from which additional non-cancer training samples were obtained to train the classifier described herein. The known cancer types included from the CCGA sample set included the following: breast, lung, prostate, colorectal, renal, uterine, pancreas, esophageal, lymphoma, head and neck, ovarian, hepatobiliary, melanoma, cervical, multiple myeloma, leukemia, thyroid, bladder, gastric, and anorectal. As such, a model can be a multi-cancer model (or a multi-cancer classifier) for detecting one or more, two or more, three or more, four or more, five or more, ten or more, or 20 or more different types of cancer.

Classifier performance data shown below for Assay Panels 1-6, was reported out for a locked classifier trained on cancer and non-cancer samples obtained from the CCGA sub-study (CCGA2) and the STRIVE study. The individuals in the CCGA2 sub-study were different from the individuals in the CCGA1 sub-study whose cfDNA was used to select target genomes. From the CCGA2 study, blood samples were collected from individuals diagnosed with untreated cancer (including 20 tumor types and all stages of cancer) and healthy individuals with no cancer diagnosis (controls). For STRIVE, blood samples were collected from women within 28 days of their screening mammogram. Cell-free DNA (cfDNA) was extracted from each sample and treated with bisulfite to convert unmethylated cytosines to uracils. The bisulfite treated cfDNA was enriched for informative cfDNA molecules using hybridization probes designed to enrich bisulfite-converted nucleic acids derived from each of a plurality of targeted genomic regions in an assay panel comprising all of the genomic regions of Assay Panels 1-6. The enriched bisulfite-converted nucleic acid molecules were sequenced using paired-end sequencing on an Illumina platform (San Diego, Calif.) to obtain a set of sequence reads for each of the training samples, and the resulting read pairs were aligned to the reference genome, assembled into fragments, and methylated and unmethylated CpG sites identified.

Classifier performance was evaluated for Assay Panels 1-6, and reported in this Example and in FIGS. 14-27, over a set of training samples that included 3,053 samples (1,532 cancer samples and 1,521 non-cancer samples). All sample types used for evaluating classifier performance are shown below in Table 3.

TABLE 3

Cancer diagnoses of individuals whose cfDNA was used to train the classifier

| Cancer Type | Total | Stage | | | | Not Reported |
|---|---|---|---|---|---|---|
| | | I | II | III | IV | |
| Non-cancer | 1521 | — | — | — | — | — |
| Lung | 261 | 60 | 23 | 72 | 106 | 0 |
| Breast | 247 | 102 | 110 | 27 | 8 | 0 |
| Prostate | 188 | 39 | 113 | 19 | 17 | 0 |
| Lymphoid neoplasm | 147 | 15 | 27 | 27 | 39 | 39 |
| Colorectal | 121 | 13 | 22 | 41 | 45 | 0 |
| Pancreas and gallbladder | 95 | 15 | 15 | 19 | 46 | 0 |
| Uterine | 84 | 73 | 3 | 5 | 3 | 0 |
| Upper GI | 67 | 9 | 12 | 19 | 27 | 0 |
| Head and neck | 62 | 7 | 13 | 16 | 26 | 0 |
| Renal | 56 | 37 | 4 | 4 | 11 | 0 |
| Ovary | 37 | 4 | 2 | 25 | 6 | 0 |
| Multiple myeloma | 34 | 10 | 13 | 11 | 0 | 0 |
| Not reported | 29 | 8 | 5 | 7 | 6 | 3 |
| Liver bile duct | 29 | 5 | 7 | 7 | 10 | 0 |
| Sarcoma | 17 | 2 | 4 | 5 | 6 | 0 |
| Bladder and urothelial | 16 | 6 | 7 | 3 | 1 | 0 |
| Anorectal | 14 | 4 | 5 | 5 | 0 | 0 |
| Cervical | 11 | 8 | 1 | 2 | 0 | 0 |
| Melanoma | 7 | 3 | 1 | 0 | 3 | 0 |
| Myeloid neoplasm | 4 | 2 | 1 | 0 | 1 | 0 |
| Thyroid | 4 | 0 | 0 | 0 | 0 | 4 |
| Prediction only | 2 | 0 | 0 | 0 | 2 | 0 |

Mixture Model Based Featurization

For each cancer type (including non-cancer) a probabilistic mixture model was trained and utilized to assign a probability to each fragment from each cancer and non-cancer sample based on how likely it was that the fragment would be observed in a given sample type.

Briefly, for each sample type (cancer and non-cancer samples), for each region (where each region was 1 kb in length with a 50% overlap between adjacent regions), a probabilistic model was fit to the fragments derived from the training samples for each type or cancer and non-cancer. The probabilistic model trained for each sample type was a mixture model, where each of three mixture components was an independent-sites model in which methylation at each CpG is assumed to be independent of methylation at other CpGs. Fragments were excluded from the model if: they had a p-value greater than 0.01, were marked as duplicate fragments, the fragments had a bag size of greater than 1; they did not cover at least one CpG site; or if the fragment was greater than 1000 bases in length.

Each probabilistic model was fit using maximum-likelihood estimation to identify a set of parameters that maximized the log-likelihood of all fragments deriving from each sample type, subject to a regularization penalty.

Featurization

Features were extracted for each fragment from each training sample, for each cancer type and non-cancer sample, in each region. The extracted features were the tallies of outlier fragments (i.e., anomalously methylated fragments), which were defined as those whose log-likelihood under a first cancer model exceeded the log-likelihood under a second cancer model or non-cancer model by at least a threshold tier value. Outlier fragments were tallied separately for each genomic region, sample model (i.e., cancer type), and tier (for tiers 1, 2, 3, 4, 5, 6, 7, 8, and 9), yielding 9 features per region for each sample type.

Feature Ranking and Classifier Training

For each set of pairwise features, the features were ranked using mutual information based on their ability to distinguish the first cancer type (which defined the log-likelihood model from which the feature was derived) from the second cancer type or non-cancer. The top ranked 256 features from each pairwise comparison were identified and added to the final feature set for each cancer type and non-cancer. The features in the final feature set for each sample (cancer type and non-cancer) were binarized (any feature value greater than 0 was set to 1, so that all features were either 0 or 1). The training samples were then divided into distinct 5-fold cross-validation training sets and used to train a logistic regression classifier (for detecting the presence of cancer) and a multiclass logistic regression classifier (for determining cancer tissue of origin). During the classifier training process, the cross-validated scores assigned to the training set were collected.

Once the binary cancer/non-cancer classifier was trained, a probability score was determined from the classifier for each of the training samples. Training samples with a probability score that exceeded a threshold were called as positive for cancer. This threshold was prespecified to target a desired specificity level, based on the distribution of cross-validated scores assigned to the training set. For example, if the desired specificity level was 99.4%, the threshold would be set to the 99.4th percentile of the cross-validated cancer detection probability scores assigned to the non-cancer samples in the training set. A tissue of origin or cancer type assessment was subsequently made for each training sample determined to be positive for cancer from the multiclass classifier. First, the multiclass logistic regression classifier assigned a set of probability scores, one for each prospective cancer type, to each sample. Next, the confidence of these scores was assessed as the difference between the highest and second-highest scores. A threshold was prespecified as the minimum value such that, of the cancer samples in the training set with a top-two score differential exceeding the threshold, 90% had been assigned the correct TOO label as their highest score. For prediction on new samples, samples with a top-two score differential lower than this threshold received an assignment of "indeterminate cancer"; those whose score differential exceeded the threshold were assigned the cancer label to which the multiclass classifier assigned the highest score.

6.6.8. Example 8: Classifier Performance

As a proxy for testing different probe sets (bait sets), classifier performance was determined for each of Assay Panels 1-6 by constraining the data set and only considering the methylation status of CpG sites within fragments that would be enriched for by the specified Assay Panels.

The results of the classifier performance analysis are provided in Tables 11 to 18. For each set of genomic regions (i.e., Assay Panels 1-6), the Detection column of the tables indicates the performance of the classifier over the indicated Assay Panels. Here, Detection is the sensitivity for all cancer types included in the CCGA2 study stratified by cancer stage at 99% specificity. The Tissue of Origin column indicates the accuracy of a tissue of origin classification at 99% specificity only for individuals diagnosed with cancer and when sufficient methylation data was available to assign a tissue of origin. Values indicate mean accuracy, with a 95% confidence interval in brackets and the number correctly assigned divided by the total in the category in parenthesis.

TABLE 11

Classification accuracy using the genomic regions of Assay Panel 1

| Stage | Detection* | Tissue of Origin* |
|---|---|---|
| I | 16.1% [12.7-20] (68/422) | 76.9% [63.2-87.5] (40/52) |
| II | 40.5% [35.5-45.5] (157/388) | 89.6% [83.1-94.2] (120/134) |
| III | 75.7% [70.6-80.4] (237/313) | 90.2% [85.5-93.9] (194/215) |
| IV | 89.3% [85.6-92.2] (324/363) | 91.9% [88.3-94.8] (274/298) |
| All | 52.2% [49.6-54.7] (799/1532) | 89.9% [87.4-92] (640/712) |

TABLE 12

Classification accuracy using the genomic regions of Assay Panel 2

| Stage | Detection* | Tissue of Origin* |
|---|---|---|
| I | 19.2% [15.5-23.3] (81/422) | 68.9% [55.7-80.1] (42/61) |
| II | 43.3% [38.3-48.4] (168/388) | 86.4% [79.8-91.5] (127/147) |
| III | 78% [72.9-82.4] (244/313) | 91.4% [87-94.8] (203/222) |
| IV | 90.1% [86.5-93] (327/363) | 94.3% [91-96.6] (280/297) |
| All | 54.6% [52-57.1] (836/1532) | 89.8% [87.3-91.8] (666/742) |

TABLE 13

Classification accuracy using the genomic regions of Assay Panel 3

| Stage | Detection* | Tissue of Origin* |
|---|---|---|
| I | 19.2% [15.5-23.3] (81/422) | 76.3% [63.4-86.4] (45/59) |
| II | 43.6% [38.6-48.7] (169/388) | 86.3% [79.8-91.3] (132/153) |
| III | 79.9% [75-84.2] (250/313) | 91% [86.6-94.4] (213/234) |
| IV | 90.6% [87.2-93.4] (329/363) | 92.6% [89.1-95.3] (289/312) |
| All | 55.4% [52.9-57.9] (849/1532) | 89.7% [87.3-91.8] (697/777) |

TABLE 14

Classification accuracy using the genomic regions of Assay Panel 4

| Stage | Detection* | Tissue of Origin* |
|---|---|---|
| I | 22% [18.2-26.3] (93/422) | 71.6% [59.3-82] (48/67) |
| II | 44.3% [39.3-49.4] (172/388) | 86.2% [79.7-91.2] (131/152) |
| III | 81.2% [76.4-85.3] (254/313) | 91.7% [87.3-94.9] (209/228) |
| IV | 90.4% [86.8-93.2] (328/363) | 93.4% [90-95.9] (284/304) |
| All | 56.8% [54.3-59.3] (870/1532) | 89.6% [87.3-91.7] (691/771) |

TABLE 15

Classification accuracy using the genomic regions of Assay Panel 5

| Stage | Detection* | Tissue of Origin* |
|---|---|---|
| I | 21.8% [18-26] (92/422) | 75.4% [63.5-84.9] (52/69) |
| II | 43.3% [38.3-48.4] (168/388) | 89.1% [83.1-93.5] (139/156) |
| III | 82.4% [77.8-86.5] (258/313) | 92.2% [88-95.3] (214/232) |
| IV | 90.4% [86.8-93.2] (328/363) | 91.7% [88-94.5] (286/312) |
| All | 56.7% [54.2-59.2] (869/1532) | 89.6% [87.3-91.7] (709/791) |

TABLE 16

Classification accuracy using the genomic regions of Assay Panel 6

| Stage | Detection* | Tissue of Origin* |
|---|---|---|
| I | 22% [18.2-263] (93/422) | 75.3% [63.9-84.7] (55/73) |
| II | 45.6% [40.6-50.7] (177/388) | 87.3% [81.3-92] (145/166) |
| III | 81.8% [77.1-85.9] (256/313) | 91.7% [87.5-94.9] (222/242) |

TABLE 16-continued

Classification accuracy using the genomic regions of Assay Panel 6

| Stage | Detection* | Tissue of Origin* |
|---|---|---|
| IV | 90.1% [86.5-93] (327/363) | 92.1% [88.6-94.8] (292/317) |
| All | 57.1% [54.6-59.6] (875/1532) | 89.5% [87.2-91.5] (733/819) |

TABLE 17

Classification accuracy using the genomic regions of Assay Panel 3A

| Stage | Detection* | Tissue of Origin* |
|---|---|---|
| I | 16.1% [12.7-20] (68/422) | 71.7% [57.7-83.2] (38/53) |
| II | 40.2% [35.3-45.3] (156/388) | 87% [80.4-92] (127/146) |
| III | 74.8% [69.6-79.5] (234/313) | 92% [87.5-95.3] (195/212) |
| IV | 88.2% [84.4-91.3] (320/363) | 91.8% [88.1-94.7] (269/293) |
| All | 52.2% [49.6-54.7] (799/1532) | 89.3% [86.9-91.5] (645/722) |

TABLE 18

Classification accuracy using the genomic regions of Assay Panel 4A

| Stage | Detection* | Tissue of Origin* |
|---|---|---|
| I | 17.3% [13.8-21.3] (73/422) | 74.1% [60.3-85] (40/54) |
| II | 40.7% [35.8-45] (158/388) | 88.5% [82.2-93.2] (131/148) |
| III | 79.2% [74.3-83.6] (248/313) | 89.7% [85-93.3] (208/232) |
| IV | 89% [53-92] (323/363) | 92.3% [88.7-95] (286/310) |
| All | 53.7% [51.1-56.2] (822/1532) | 89.4% [87-91.5] (682/763) |

These results show that the accuracy of detection and tissue of origin determination is higher for later stage cancers than early stage cancers. Additionally, larger panels apparently provide more accurate cancer detection for stage I and stage II cancers.

Part A of FIGS. 14-21 presents receiver operator curves (ROC curves) for Assay Panels 1-6 and 3A and 4A from the binary logistic regression classifier using mixture model based featurization described above. The ROC curve results were similar for all Assay Panels, showing an area under the curves (AUC) falling within a narrow range of 0.80 to 0.83. Part B of FIGS. 14-21 presents confusion matrices showing tissue of origin (TOO) accuracy determined for the multi-class logistic regression classifier trained using mixture model-based features, as described above. As shown in FIGS. 14-21, TOO precision ranged from 89.9% to 91.1% across Assay Panels 1-6.

The classification performance for random subsets of the markers in Assay Panels 3-5, at 99% specificity, are presented in Tables 19-24.

TABLE 19

Classification accuracy using a randomly selected subset of 40% of the genomic regions of Assay Panel 3 (subset a)

| Stage | Detection* | Tissue of Origin* |
|---|---|---|
| I | 18.5% [14.9-22.5] (78/422) | 73.2% [59.7-84.2] (41/56) |
| II | 42% [37-47.1] (163/388) | 87.9% [81.3-92.8] (123/140) |
| III | 79.6% [74.7-83.9] (249/313) | 92.6% [88.2-95.7] (200/216) |
| IV | 89.5% [859-92.5] (325/363) | 91% [87.2-94] (274/301) |
| All | 54.4% [51.9-57] (834/1532) | 89.6% [87.1-91.7] (654/730) |

TABLE 20

Classification accuracy using a randomly selected subset of 40% of the genomic regions of Assay Panel 3 (subset b)

| Stage | Detection* | Tissue of Origin* |
|---|---|---|
| I | 17.8% [14.2-21.8] (75/422) | 75% [61.6-85.6] (42/56) |
| II | 41.5% [36.5-46.6] (161/388) | 85.9% [79.1-91.2] (122/142) |
| III | 77.6% [72.6-82.1] (243/313) | 92.3% [88-95.5] (205/222) |
| IV | 89.3% [85.6-92.2] (324/363) | 91.7% [88.1-94.6] (278/303) |
| All | 53.6% [51.1-56.1] (821/1.532) | 89.5% [87-91.6] (663/741) |

TABLE 21

Classification accuracy using a randomly selected subset of 40% of the genomic regions of Assay Panel 3 (subset c)

| Stage | Detection* | Tissue of Origin* |
|---|---|---|
| I | 16.8% [13.4-20.7] (71/422) | 79.6% [66.5-89.4] (43/54) |
| II | 42.5% [37.6-47.6] (165/388) | 85% [78.2-90.4] (125/147) |
| III | 77.3% [72.3-81.8] (242/313) | 91.8% [87.2-95.2] (191/208) |
| IV | 89.5% [85.9-92.5] (325/363) | 92.3% [88.6-95] (275/298) |
| All | 53.7% [51.2-56.2] (823/1532) | 89.7% [87.2-91.8] (650/725) |

TABLE 22

Classification accuracy using a randomly selected subset of 60% of the genomic regions of Assay Panel 3

| Stage | Detection* | Tissue of Origin* |
|---|---|---|
| I | 18% [14.5-22] (76/422) | 71.4% [57.8-82.7] (40/56) |
| II | 41.2% [36.3-46.3] (160/388) | 86% [79.2-91.2] (123/143) |
| III | 78.6% [73.6-83] (246/313) | 91.1% [86.6-94.5] (205/225) |
| IV | 89.5% [85.9-92.5] (325/363) | 91.6% [87.8-94.5] (272/297) |
| All | 54% [51.5-56.6] (828/1532) | 88.7% [86.2-90.9] (658/742) |

TABLE 23

Classification accuracy using a randomly selected subset of 50% of the genomic regions of Assay Panel 4

| Stage | Detection* | Tissue of Origin* |
|---|---|---|
| I | 18.5% [14.9-22.5] (78/422) | 80.7% [68.1-90] (46/57) |
| II | 44.3% [39.3-49.4] (172/388) | 82.9% [76-88.5] (126/152) |
| III | 78.9% [74-83.3] (247/313) | 91.7% [87.3-95] (200/218) |
| IV | 90.4% [86.8-93.2] (328/363) | 92.4% [88.9-95.1] (281/304) |
| All | 55.3% [52.8-57.8] (847/1532) | 89.5% [87-91.6] (670/749) |

TABLE 24

Classification accuracy using a randomly selected subset of 50% of the genomic regions of Assay Panel 5

| Stage | Detection* | Tissue of Origin* |
|---|---|---|
| I | 20.4% [16.6-24.5] (86/422) | 73.8% [61.5-84] (48/65) |
| II | 43.3% [38.3-48.4] (168/388) | 87% [80.7-91.9] (134/154) |
| III | 80.2% [75.3-84.5] (251/313) | 90.7% [86.2-94.2] (206/227) |
| IV | 89% [53-92] (323/363) | 92.7% [89.2-95.4] (281/303) |
| All | 55.4% [52.8-57.9] (848/1532) | 89.4% [87-91.5] (686/767) |

Part A of FIGS. 22-27 presents receiver operator curves (ROC curves) for randomly selected subsets of Assay Panels 3-4 from the trained binary logistic regression classifier using mixture model based featurization, as described above. Classifier performance results for the same random subsets the markers are also shown in Tables 19-24. As shown, the areas under the curve (AUC) for these receiver operator curves (ROC curves) were similar to each other and similar to the areas under the curve (AUC) for the complete assay panels. A summary of the area under the curve results (AUC) for each Assay Panel is presented in Table 25. Part B of FIGS. 22-27 presents confusion matrices showing tissue of origin (TOO) accuracy determined for the multi-class logistic regression classifier described above. As shown in FIGS. 22-27, TOO precision ranged from 90.4% to 90.7% for the randomly selected subsets of Assay Panels 3-4.

TABLE 25

Areas under the curves for cancer classification.

| Assay Panel | AUC |
| --- | --- |
| 1 | 0.81 |
| 2 | 0.82 |
| 3 | 0.82 |
| 4 | 0.83 |
| 5 | 0.83 |
| 6 | 0.83 |
| 3A | 0.80 |
| 4A | 0.82 |
| 3 Random 40% a | 0.81 |
| 3 Random 40% b | 0.82 |
| 3 Random 40% c | 0.82 |
| 3 Random 60% | 0.82 |
| 4 Random 50% | 0.82 |
| 5 Random 50% | 0.78 |

Table 26 shows tissue of origin accuracy for each cancer type at a specificity of 0.994 for Assay Panels 1, 3A and 5. Each column shows TOO precision with a 95% confidence interval in brackets and in parenthesis the number correctly assigned divided by the total number of samples correctly detected as having cancer under the binary logistic regression classifier described above.

TABLE 26

TOO precision for Assay Panels 1, 3A, and 5

| Cancer Type | Assay Panel 1 | Assay Panel 3A | Assay Panel 5 |
| --- | --- | --- | --- |
| Lung | 97% [93.2-99] (163/168) | 97% [93.2-99] (163/168) | 97.3% [93.7-99.1] (178/183) |
| Colorectal | 97.8% [92.2-99.7] (88/90) | 97.7% [91.9-99.7] (84/86) | 98.9% [94.3-100] (94/95) |
| Lymphoid neoplasm | 100% [95.4-100] (79/79) | 100% [95.9-100] (89/89) | 100% [96-100] (90/90) |

TABLE 26-continued

TOO precision for Assay Panels 1, 3A, and 5

| Cancer Type | Assay Panel 1 | Assay Panel 3A | Assay Panel 5 |
| --- | --- | --- | --- |
| Breast | 98.6% [92.3-100] (69/70) | 98.6% [92.2-100] (68/69) | 98.8% [93.5-100] (82/83) |
| Pancreas Gallbladder | 87.7% [77.2-94.5] (57/65) | 90.9% [81.3-96.6] (60/66) | 90.5% [81.5-96.1] (67/74) |
| Head and Neck | 89.8% [77.8-96.6] (44/49) | 85.1% [71.7-93.8] (40/47) | 88.2% [76.1-95.6] (45/51) |
| Upper GI | 80.9% [66.7-90.9] (38/47) | 89.8% [77.8-96.6] (44/49) | 86.5% [74.2-94.4] (45/52) |
| Ovary | 86.4% [65.1-97.1] (19/22) | 91.3% [72-98.9] (21/23) | 88.9% [70.8-97.6] (24/27) |
| Liver/Bile Duct | 77.8% [52.4-93.6] (14/18) | 70.8% [48.9-87.4] (17/24) | 77.3% [54.6-92.2] (17/22) |
| Uterine | 100% [75.3-100] (13/13) | 92.9% [66.1-99.8] (13/14) | 95.2% [76.2-99.9] (20/21) |
| Prostate | 92.3% [64-99.8] (12/13) | 87.5% [61.7-98.4] (14/16) | 94.4% [72.7-99.9] (17/18) |
| Multiple Myeloma | 92.3% [64-99.8] (12/13) | 94.7% [74-99.9] (18/19) | 91.3% [72-98.9] (21/23) |
| Renal | 100% [69.2-100] (10/10) | 100% [66.4-100] (9/9) | 100% [73.5-100] (12/12) |
| Anorectal | 0% [0-45.9] (0/6) | 0% [0-33.6] (0/9) | 12.5% [0.3-52.7] (1/8) |
| Bladder and urothelia | 0% [0-60.2] (0/4) | 40% [5.3-85.3] (2/5) | 50% [11.8-88.2] (3/6) |
| Sarcoma | 66.7% [9.4-99.2] (2/3) | 25% [0.6-80.6] (1/4) | 50% [6.8-93.2] (2/4) |
| Cervical | 0% [0-97.5] (0/1) | 100% [15.8-100] (2/2) | 25% [0.6-80.6] (1/4) |
| Melanoma | 100% [2.5-100] (1/1) | 66.7% [9.4-99.2] (2/3) | 100% [29.2-100] (3/3) |

Tables 27-29 show classifier performance for the binary logistic regression classifier described above for Assay Panels 1, 3A and 5. Each tables shows the sensitivity for each cancer type, stratified by stage, at a specificity of 0.994. Each column also shows the 95% confidence interval in brackets and in parenthesis the number correctly detected divided by the total number of samples in the data set for each cancer type, at stages I through IV.

TABLE 27

Classifier performance by cancer type and stage for Assay Panel 1

| Cancer Type | I | II | III | IV | All Stages |
| --- | --- | --- | --- | --- | --- |
| Lung | 16.7% [8.3-28.5] (10/60) | 78.3% [56.3-92.5] (18/23) | 83.3% [72.7-91.1] (60/72) | 86.8% [78.8-92.6] (92/106) | 69% [63-74.5] (180/261) |
| Prostate | 0% [0-9] (0/39) | 0.9% [0-4.8] (1/113) | 10.5% [1.3-33.1] (2/19) | 76.5% [50.1-93.2] (13/17) | 8.5% [4.9-13.5] (16/188) |
| Breast HR positive | 2.3% [0.3-8.1] (2/87) | 20% [11.4-31.3] (14/70) | 71.4% [41.9-91.6] (10/14) | 100% [54.1-100] (6/6) | 18.1% [12.7-24.6] (32/177) |
| Lymphoid neoplasm | 20% [4.3-48.1] (3/15) | 74.1% [53.7-88.9] (20/27) | 70.4% [49.8-86.2] (19/27) | 76.9% [60.7-88.9] (30/39) | 56.5% [48-64.6] (83/147) |

TABLE 27-continued

Classifier performance by cancer type and stage for Assay Panel 1

| Cancer Type | I | II | III | IV | All Stages |
|---|---|---|---|---|---|
| Colorectal | 41.2% [18.4-67.1] (7/17) | 66.7% [46-83.5] (18/27) | 80.4% [66.1-90.6] (37/46) | 93.3% [81.7-98.6] (42/45) | 77% [69-83.8] (104/135) |
| Pancreas | 58.3% [27.7-84.8] (7/12) | 71.4% [41.9-91.6] (10/14) | 81.2% [54.4-96] (13/16) | 92.9% [80.5-98.5] (39/42) | 82.1% [72.3-89.6] (69/84) |
| Endometrial carcinoma | 13.7% [6.8-23.8] (10/73) | 33.3% [0.8-90.6] (1/3) | 60% [14.7-94.7] (3/5) | 66.7% [9.4-99.2] (2/3) | 19% [11.3-29.1] (16/84) |
| Breast HR negative | 0% [0-21.8] (0/15) | 62.5% [45.8-77.3] (25/40) | 100% [75.3-100] (13/13) | 100% [15.8-100] (2/2) | 57.1% [44.7-68.9] (40/70) |
| Head and Neck | 85.7% [42.1-99.6] (6/7) | 76.9% [46.2-95] (10/13) | 87.5% [61.7-98.4] (14/16) | 88.5% [69.8-97.6] (23/26) | 85.5% [74.2-93.1] (53/62) |
| Renal | 0% [0-9.5] (0/37) | 0% [0-60.2] (0/4) | 50% [6.8-93.2] (2/4) | 81.8% [48.2-97.7] (9/11) | 19.6% [10.2-32.4] (11/56) |
| Ovary | 25% [0.6-80.6] (1/4) | 0% [0-84.2] (0/2) | 68% [46.5-85.1] (17/25) | 100% [54.1-100] (6/6) | 64.9% [47.5-79.8] (24/37) |
| Multiple Myeloma | 20% [2.5-55.6] (2/10) | 23.1% [5-53.8] (3/13) | 90.9% [58.7-99.8] (10/11) | — | 44.1% [27.2-62.1] (15/34) |
| Esophagus | 16.7% [0.4-64.1] (1/6) | 75% [34.9-96.8] (6/8) | 82.4% [56.6-96.2] (14/17) | 100% [82.4-100] (19/19) | 80% [66.3-90] (40/50) |
| Multiple myeloma | 20% [2.5-55.6] (2/10) | 23.1% [5-53.8] (3/13) | 90.9% [58.7-99.8] (10/11) | — | 44.1% [27.2-62.1] (15/34) |
| Biliary tract | 25% [0.6-80.6] (1/4) | 80% [28.4-99.5] (4/5) | 60% [14.7-94.7] (3/5) | 100% [69.2-100] (10/10) | 75% [53.3-90.2] (18/24) |
| Gastric | 0% [0-70.8] (0/3) | 75% [19.4-99.4] (3/4) | 100% [15.8-100] (2/2) | 100% [63.1-100] (8/8) | 76.5% [50.1-93.2] (13/17) |
| Hepatocellular | 25% [0.6-80.6] (1/4) | 66.7% [9.4-99.2] (2/3) | 100% [47.8-100] (5/5) | 100% [39.8-100] (4/4) | 75% [47.6-92.7] (12/16) |
| Sarcoma | 100% [2.5-100] (1/1) | 0% [0-60.2] (0/4) | 20% [0.5-71.6] (1/5) | 66.7% [22.3-95.7] (4/6) | 37.5% [15.2-64.6] (6/16) |
| Bladder | 60% [14.7-94.7] (3/5) | 66.7% [9.4-99.2] (2/3) | 50% [1.3-98.7] (1/2) | 0% [0-97.5] (0/1) | 54.5% [23.4-83.3] (6/11) |
| Cervical | 12.5% [0.3-52.7] (1/8) | 100% [2.5-100] (1/1) | 100% [15.8-100] (2/2) | — | 36.4% [10.9-69.2] (4/11) |
| Melanoma | 0% [0-70.8] (0/3) | 0% [0-97.5] (0/1) | — | 100% [29.2-100] (3/3) | 42.9% [9.9-81.6] (3/7) |
| Renal Pelvis Urothelial | 100% [2.5-100] (1/1) | 50% [6.8-93.2] (2/4) | — | — | 60% [14.7-94.7] (3/5) |
| Uterine sarcoma | 100% [2.5-100] (1/1) | — | — | — | 100% [2.5-100] (1/1) |
| Myeloid neoplasm | — | — | — | — | 0% [0-60.2] (0/4) |
| Thyroid | 0% [0-84.2] (0/2) | 0% [0-97.5] (0/1) | — | 0% [0-97.5] (0/1) | 0% [0-60.2] (0/4) |

TABLE 28

Classifier performance by cancer type and stage for Assay Panel 3A

| Cancer Type | I | II | III | IV | All Stages |
|---|---|---|---|---|---|
| Lung | 13.3% [5.9-24.6] (8/60) | 73.9% [51.6-89.8] (17/23) | 79.2% [68-87.8] (57/72) | 86.8% [78.8-92.6] (92/106) | 66.7% [60.6-72.4] (174/261) |

TABLE 28-continued

Classifier performance by cancer type and stage for Assay Panel 3A

| Cancer Type | I | II | III | IV | All Stages |
|---|---|---|---|---|---|
| Prostate | 0%<br>[0-9]<br>(0/39) | 1.8%<br>[0.2-6.2]<br>(2/113) | 10.5%<br>[1.3-33.1]<br>(2/19) | 76.5%<br>[50.1-93.2]<br>(13/17) | 9%<br>[5.4-14.1]<br>(17/188) |
| Breast HR positive | 2.3%<br>[0.3-8.1]<br>(2/87) | 18.6%<br>[10.3-29.7]<br>(13/70) | 71.4%<br>[41.9-91.6]<br>(10/14) | 83.3%<br>[35.9-99.6]<br>(5/6) | 16.9%<br>[11.7-23.3]<br>(30/177) |
| Lymphoid neoplasm | 26.7%<br>[7.8-55.1]<br>(4/15) | 81.5%<br>[61.9-93.7]<br>(22/27) | 70.4%<br>[49.8-86.2]<br>(19/27) | 74.4%<br>[57.9-87]<br>(29/39) | 61.9%<br>[53.5-69.8]<br>(91/147) |
| Colorectal | 35.3%<br>[14.2-61.7]<br>(6/17) | 51.9%<br>[31.9-71.3]<br>(14/27) | 78.3%<br>[63.6-89.1]<br>(36/46) | 93.3%<br>[81.7-98.6]<br>(42/45) | 72.6%<br>[64.3-79.9]<br>(98/135) |
| Pancreas | 33.3%<br>[9.9-65.1]<br>(4/12) | 71.4%<br>[41.9-91.6]<br>(10/14) | 75%<br>[47.6-92.7]<br>(12/16) | 92.9%<br>[80.5-98.5]<br>(39/42) | 77.4%<br>[67-85.8]<br>(65/84) |
| Endometrial carcinoma | 15.1%<br>[7.8-25.4]<br>(11/73) | 33.3%<br>[0.8-90.6]<br>(1/3) | 60%<br>[14.7-94.7]<br>(3/5) | 33.3%<br>[0.8-90.6]<br>(1/3) | 19%<br>[11.3-29.1]<br>(16/84) |
| Breast HR negative | 0%<br>[0-21.8]<br>(0/15) | 65%<br>[48.3-79.4]<br>(26/40) | 100%<br>[75.3-100]<br>(13/13) | 100%<br>[15.8-100]<br>(2/2) | 58.6%<br>[46.2-70.2]<br>(41/70) |
| Head and Neck | 85.7%<br>[42.1-99.6]<br>(6/7) | 84.6%<br>[54.6-98.1]<br>(11/13) | 81.2%<br>[54.4-96]<br>(13/16) | 88.5%<br>[69.8-97.6]<br>(23/26) | 85.5%<br>[74.2-93.1]<br>(53/62) |
| Renal | 0%<br>[0-9.5]<br>(0/37) | 25%<br>[0.6-80.6]<br>(1/4) | 50%<br>[6.8-93.2]<br>(2/4) | 72.7%<br>[39-94]<br>(8/11) | 19.6%<br>[10.2-32.4]<br>(11/56) |
| Ovary | 25%<br>[0.6-80.6]<br>(1/4) | 0%<br>[0-84.2]<br>(0/2) | 72%<br>[50.6-87.9]<br>(18/25) | 100%<br>[54.1-100]<br>(6/6) | 67.6%<br>[50.2-82]<br>(25/37) |
| Multiple Myeloma | 40%<br>[12.2-73.8]<br>(4/10) | 46.2%<br>[19.2-74.9]<br>(6/13) | 100%<br>[71.5-100]<br>(11/11) | — | 61.8%<br>[43.6-77.8]<br>(21/34) |
| Esophagus | 16.7%<br>[0.4-64.1]<br>(1/6) | 75%<br>[34.9-96.8]<br>(6/8) | 82.4%<br>[56.6-96.2]<br>(14/17) | 94.7%<br>[74-99.9]<br>(18/19) | 78%<br>[64-88.5]<br>(39/50) |
| Multiple myeloma | 40%<br>[12.2-73.8]<br>(4/10) | 46.2%<br>[19.2-74.9]<br>(6/13) | 100%<br>[71.5-100]<br>(11/11) | — | 61.8%<br>[43.6-77.8]<br>(21/34) |
| Biliary tract | 25%<br>[0.6-80.6]<br>(1/4) | 80%<br>[28.4-99.5]<br>(4/5) | 60%<br>[14.7-94.7]<br>(3/5) | 100%<br>[69.2-100]<br>(10/10) | 75%<br>[53.3-90.2]<br>(18/24) |
| Gastric | 0%<br>[0-70.8]<br>(0/3) | 100%<br>[39.8-100]<br>(4/4) | 100%<br>[15.8-100]<br>(2/2) | 100%<br>[63.1-100]<br>(8/8) | 82.4%<br>[56.6-96.2]<br>(14/17) |
| Hepatocellular | 50%<br>[6.8-93.2]<br>(2/4) | 100%<br>[29.2-100]<br>(3/3) | 100%<br>[47.8-100]<br>(5/5) | 100%<br>[39.8-100]<br>(4/4) | 87.5%<br>[61.7-98.4]<br>(14/16) |
| Sarcoma | 0%<br>[0-97.5]<br>(0/1) | 0%<br>[0-60.2]<br>(0/4) | 20%<br>[0.5-71.6]<br>(1/5) | 50%<br>[11.8-88.2]<br>(3/6) | 25%<br>[7.3-52.4]<br>(4/16) |
| Bladder | 40%<br>[5.3-85.3]<br>(2/5) | 66.7%<br>[9.4-99.2]<br>(2/3) | 50%<br>[1.3-98.7]<br>(1/2) | 0%<br>[0-97.5]<br>(0/1) | 45.5%<br>[16.7-76.6]<br>(5/11) |
| Cervical | 12.5%<br>[0.3-52.7]<br>(1/8) | 100%<br>[2.5-100]<br>(1/1) | 100%<br>[15.8-100]<br>(2/2) | — | 36.4%<br>[10.9-69.2]<br>(4/11) |
| Melanoma | 0%<br>[0-70.8]<br>(0/3) | 0%<br>[0-97.5]<br>(0/1) | — | 100%<br>[29.2-100]<br>(3/3) | 42.9%<br>[9.9-81.6]<br>(3/7) |
| Renal Pelvis Urothelial | 100%<br>[2.5-100]<br>(1/1) | 25%<br>[0.6-80.6]<br>(1/4) | — | — | 40%<br>[5.3-85.3]<br>(2/5) |
| Uterine sarcoma | 100%<br>[2.5-100]<br>(1/1) | — | — | — | 100%<br>[2.5-100]<br>(1/1) |
| Myeloid neoplasm | — | — | — | — | 0%<br>[0-60.2]<br>(0/4) |
| Thyroid | 0%<br>[0-84.2]<br>(0/2) | 0%<br>[0-97.5]<br>(0/1) | — | 0%<br>[0-97.5]<br>(0/1) | 0%<br>[0-60.2]<br>(0/4) |

TABLE 29

Classifier performance by cancer type and stage for Assay Panel 5

| Cancer Type | I | II | III | IV | All Stages |
|---|---|---|---|---|---|
| Lung | 20% | 78.3% | 86.1% | 91.5% | 72.4% |
|  | [10.8-32.3] | [56.3-92.5] | [75.9-93.1] | [84.5-96] | [66.6-77.7] |
|  | (12/60) | (18/23) | (62/72) | (97/106) | (189/261) |
| Prostate | 2.6% | 4.4% | 10.5% | 76.5% | 11.2% |
|  | [0.1-13.5] | [1.5-10] | [1.3-33.1] | [50.1-93.2] | [7-16.6] |
|  | (1/39) | (5/113) | (2/19) | (13/17) | (21/188) |
| Breast HR positive | 4.6% | 25.7% | 71.4% | 100% | 21.5% |
|  | [1.3-11.4] | [16-37.6] | [41.9-91.6] | [54.1-100] | [15.7-28.3] |
|  | (4/87) | (18/70) | (10/14) | (6/6) | (38/177) |
| Lymphoid neoplasm | 26.7% | 74.1% | 77.8% | 79.5% | 62.6% |
|  | [7.8-55.1] | [53.7-88.9] | [57.7-91.4] | [63.5-90.7] | [54.2-70.4] |
|  | (4/15) | (20/27) | (21/27) | (31/39) | (92/147) |
| Colorectal | 47.1% | 70.4% | 82.6% | 93.3% | 79.3% |
|  | [23-72.2] | [49.8-86.2] | [68.6-92.2] | [81.7-98.6] | [71.4-85.8] |
|  | (8/17) | (19/27) | (38/46) | (42/45) | (107/135) |
| Pancreas | 58.3% | 71.4% | 87.5% | 95.2% | 84.5% |
|  | [27.7-84.8] | [41.9-91.6] | [61.7-98.4] | [83.8-99.4] | [75-91.5] |
|  | (7/12) | (10/14) | (14/16) | (40/42) | (71/84) |
| Endometrial carcinoma | 20.5% | 33.3% | 60% | 66.7% | 25% |
|  | [12-31.6] | [0.8-90.6] | [14.7-94.7] | [9.4-99.2] | [16.2-35.6] |
|  | (15/73) | (1/3) | (3/5) | (2/3) | (21/84) |
| Breast HR negative | 6.7% | 72.5% | 100% | 100% | 64.3% |
|  | [0.2-31.9] | [56.1-85.4] | [75.3-100] | [15.8-100] | [51.9-75.4] |
|  | (1/15) | (29/40) | (13/13) | (2/2) | (45/70) |
| Head and Neck | 100% | 84.6% | 87.5% | 88.5% | 88.7% |
|  | [59-100] | [54.6-98.1] | [61.7-98.4] | [69.8-97.6] | [78.1-95.3] |
|  | (7/7) | (11/13) | (14/16) | (23/26) | (55/62) |
| Renal | 0% | 50% | 50% | 81.8% | 23.2% |
|  | [0-9.5] | [6.8-93.2] | [6.8-93.2] | [48.2-97.7] | [13-36.4] |
|  | (0/37) | (2/4) | (2/4) | (9/11) | (13/56) |
| Ovary | 25% | 0% | 88% | 100% | 78.4% |
|  | [0.6-80.6] | [0-84.2] | [68.8-97.5] | [54.1-100] | [61.8-90.2] |
|  | (1/4) | (0/2) | (22/25) | (6/6) | (29/37) |
| Multiple Myeloma | 40% | 46.2% | 100% | — | 61.8% |
|  | [12.2-73.8] | [19.2-74.9] | [71.5-100] |  | [43.6-77.8] |
|  | (4/10) | (6/13) | (11/11) |  | (21/34) |
| Esophagus | 25% | 80% | 60% | 100% | 75% |
|  | [0.6-80.6] | [28.4-99.5] | [14.7-94.7] | [69.2-100] | [53.3-90.2] |
|  | (1/4) | (4/5) | (3/5) | (10/10) | (18/24) |
| Multiple myeloma | 0% | 100% | 100% | 100% | 82.4% |
|  | [0-70.8] | [39.8-100] | [15.8-100] | [63.1-100] | [56.6-96.2] |
|  | (0/3) | (4/4) | (2/2) | (8/8) | (14/17) |
| Biliary tract | 50% | 100% | 100% | 100% | 87.5% |
|  | [6.8-93.2] | [29.2-100] | [47.8-100] | [39.8-100] | [61.7-98.4] |
|  | (2/4) | (3/3) | (5/5) | (4/4) | (14/16) |
| Gastric | 0% | 0% | 20% | 50% | 25% |
|  | [0-97.5] | [0-60.2] | [0.5-71.6] | [11.8-88.2] | [7.3-52.4] |
|  | (0/1) | (0/4) | (1/5) | (3/6) | (4/16) |
| Hepatocellular | 40% | 66.7% | 50% | 0% | 45.5% |
|  | [5.3-85.3] | [9.4-99.2] | [1.3-98.7] | [0-97.5] | [16.7-76.6] |
|  | (2/5) | (2/3) | (1/2) | (0/1) | (5/11) |
| Sarcoma | 12.5% | 100% | 100% | — | 36.4% |
|  | [0.3-52.7] | [2.5-100] | [15.8-100] |  | [10.9-69.2] |
|  | (1/8) | (1/1) | (2/2) |  | (4/11) |
| Bladder | 0% | 0% | — | 100% | 42.9% |
|  | [0-70.8] | [0-97.5] |  | [29.2-100] | [9.9-81.6] |
|  | (0/3) | (0/1) |  | (3/3) | (3/7) |
| Cervical | 100% | 25% | — | — | 40% |
|  | [2.5-100] | [0.6-80.6] |  |  | [5.3-85.3] |
|  | (1/1) | (1/4) |  |  | (2/5) |
| Melanoma | 100% | — | — | — | 100% |
|  | [2.5-100] |  |  |  | [2.5-100] |
|  | (1/1) |  |  |  | (1/1) |
| Renal Pelvis Urothelial | — | — | — | — | 0% |
|  |  |  |  |  | [0-60.2] |
|  |  |  |  |  | (0/4) |
| Uterine sarcoma | 0% | 0% | — | 0% | 0% |
|  | [0-84.2] | [0-97.5] |  | [0-97.5] | [0-60.2] |
|  | (0/2) | (0/1) |  | (0/1) | (0/4) |
| Myeloid neoplasm | 40% | 46.2% | 100% | — | 61.8% |
|  | [12.2-73.8 ] | [19.2-74.9] | [71.5-100] |  | [43.6-77.8] |
|  | (4/10) | (6/13) | (11/11) |  | (21/34) |
| Thyroid | 25% | 80% | 60% | 100% | 75% |
|  | [0.6-80.6] | [28.4-99.5] | [14.7-94.7] | [69.2-100] | [53.3-90.2] |
|  | (1/4) | (4/5) | (3/5) | (10/10) | (18/24) |

7. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes.

8. EQUIVALENTS

It is to be understood that the figures and descriptions of the present disclosure have been simplified to illustrate elements that are relevant for a clear understanding of the present disclosure, while eliminating, for the purpose of clarity, many other elements found in a typical system. Those of ordinary skill in the art may recognize that other elements and/or steps are desirable and/or required in implementing the present disclosure. However, because such elements and steps are well known in the art, and because they do not facilitate a better understanding of the present disclosure, a discussion of such elements and steps is not provided herein. The disclosure herein is directed to all such variations and modifications to such elements and methods known to those skilled in the art.

Some portions of above description describe the embodiments in terms of algorithms and symbolic representations of operations on information. These algorithmic descriptions and representations are commonly used by those skilled in the data processing arts to convey the substance of their work effectively to others skilled in the art. These operations, while described functionally, computationally, or logically, are understood to be implemented by computer programs or equivalent electrical circuits, microcode, or the like. The described operations and their associated modules may be embodied in software, firmware, hardware, or any combinations thereof.

As used herein any reference to "one embodiment" or "an embodiment" means that a particular element, feature, structure, or characteristic described in connection with the embodiment is included in at least one embodiment. The appearances of the phrase "in one embodiment" in various places in the specification are not necessarily all referring to the same embodiment, thereby providing a framework for various possibilities of described embodiments to function together.

As used herein, the terms "comprises," "comprising," "includes," "including," "has," "having" or any other variation thereof, are intended to cover a non-exclusive inclusion. For example, a process, method, article, or apparatus that comprises a list of elements is not necessarily limited to only those elements but may include other elements not expressly listed or inherent to such process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

In addition, use of the "a" or "an" are employed to describe elements and components of the embodiments herein. This is done merely for convenience and to give a general sense of the description. This description should be read to include one or at least one and the singular also includes the plural unless it is obvious that it is meant otherwise.

While particular embodiments and applications have been illustrated and described, it is to be understood that the disclosed embodiments are not limited to the precise construction and components disclosed herein. Various modifications, changes and variations, which will be apparent to those skilled in the art, may be made in the arrangement, operation and details of the method and apparatus disclosed herein without departing from the spirit and scope defined in the appended claims.

While various specific embodiments have been illustrated and described, the above specification is not restrictive. It will be appreciated that various changes can be made without departing from the spirit and scope of the description(s). Many variations will become apparent to those skilled in the art upon review of this specification.

SEQUENCE LISTING (131822 sequences)

SEQ ID NO: 1 - DNA, 98 bp, Homo sapiens
  chr1:3567247-3567345
  hyper
agatcaaggagagaacgaatttgccgctgactgggcagagcgagcgcgtggatcgcggccaccgcccgttcatcacccgcgcgcatctgggctggcac

SEQ ID NO: 2 - DNA, 114 bp, Homo sapiens
  chr1:3567737-3567851
  hyper
cggccttttctgttgccaaaactagacccaaacctctgcatgggattcgtctttgggtccccaccccgtgcgcccagcaaacagtgggtgagccatgaagatgtgcgagtcagc

SEQ ID NO: 3 - DNA, 395 bp, Homo sapiens
  chr1:3567882-3568277
  hyper
cggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccaga

SEQ ID NO: 4 - DNA, 113 bp, Homo sapiens
  chr1:4715427-4715540
  hyper
cgccgcgcagatggcctgggcgagccaggtctgaggccccgctccccgaaacgtgaccatgtggattcaacagcttttaggactcaggtgagcgacccggccggcgccgggtg

SEQ ID NO: 5 - DNA, 528 bp, Homo sapiens
  chr1:4715574-4716102
  hyper
cggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcaca

SEQ ID NO: 6 - DNA, 517 bp, Homo sapiens
  chr1:6480368-6480885
  hyper
cagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccc

SEQ ID NO: 7 - DNA, 15 bp, Homo sapiens
  chr1:6500973-6500988
  hyper
ctcactgcgtgcccc

SEQ ID NO: 8 - DNA, 125 bp, Homo sapiens
  chr1:6501054-6501179
  hyper
cggccgccgacctgtcggacttcaacggccacagccactgcacccgctacctgcgcacggtggagaacctggtacgatccctgagctgctcctgtcgcattctttcttctcgcccctccacccca

SEQ ID NO: 9 - DNA, 30 bp, Homo sapiens
  chr1:8277113-8277143
  hyper
tcccagagatgagggcgaggggaggggacc

SEQ ID NO: 10 - DNA, 50 bp, Homo sapiens
  chr1:11540129-11540179
  hyper
gggagccaaccccaccgccgggagaacttttcccaactccctggggaggc

SEQ ID NO: 11 - DNA, 133 bp, Homo sapiens
  chr1:12123421-12123554
  hyper
ggaaccaatttgatacgggagaactaaggctgaaacctcggaggaacaaccacttttgaagtgacttcgcggcgtgcgttgggtgcggactaggtggccgcggcgggagtgtgctggagcctgaagtccacgc

SEQ ID NO: 12 - DNA, 15 bp, Homo sapiens
  chr1:12123787-12123802
  hyper
cgcaagggaggacac

SEQ ID NO: 13 - DNA, 229 bp, Homo sapiens
  chr1:18437202-18437431
  hyper
gaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagcc

SEQ ID NO: 14 - DNA, 94 bp, Homo sapiens
  chr1:18437432-18437526
  hyper
ggggtctccgggattgcgcgggcggaggtgggcggccctgcgggttctcgggttctcgggttctctgtctccgcagccgcgtgtcagcaggtgg

SEQ ID NO: 15 - DNA, 476 bp, Homo sapiens
  chr1:18956811-18957287
  hyper
caagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatc

SEQ ID NO: 16 - DNA, 93 bp, Homo sapiens
  chr1:18960897-18960990
  hyper
gcccaccatggcatccggccctgtgtcatctcccgacagctgcgtgtctcccacggctgcgtctccaagattctttgccgctaccaggagacc

SEQ ID NO: 17 - DNA, 331 bp, Homo sapiens
  chr1:22140683-22141014
  hyper
aagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 18 - DNA, 287 bp, Homo sapiens
  chr1:22141015-22141302
  hyper
gcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcac

SEQ ID NO: 19 - DNA, 15 bp, Homo sapiens
  chr1:32237531-32237546
  hyper
cccaccgccggaagc

SEQ ID NO: 20 - DNA, 1008 bp, Homo sapiens
  chr1:32237638-32238646
  hyper
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagt

SEQ ID NO: 21 - DNA, 940 bp, Homo sapiens
  chr1:36042549-36043489
  hyper
ggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtat

SEQ ID NO: 22 - DNA, 162 bp, Homo sapiens
  chr1:38510087-38510249
  hyper
aggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacac

SEQ ID NO: 23 - DNA, 425 bp, Homo sapiens
  chr1:38510309-38510734
  hyper
gtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 24 - DNA, 160 bp, Homo sapiens
  chr1:38510773-38510933
  hyper
cgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttc

SEQ ID NO: 25 - DNA, 866 bp, Homo sapiens
  chr1:38510934-38511800
  hyper
aaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcgg

SEQ ID NO: 26 - DNA, 269 bp, Homo sapiens
  chr1:38511821-38512090
  hyper
cgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgc

SEQ ID NO: 27 - DNA, 141 bp, Homo sapiens
  chr1:44872582-44872723
  hyper
cccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 28 - DNA, 141 bp, Homo sapiens
  chr1:44872923-44873064
  hyper
ggactcggcttgaggggcaaaggggagagaaaggaaaaataaagaaaaaaaagggcggcagtgaggaagcagcgaggggactggggggagcagagtgggcaggggggctttgccttgcctggcctcctctttccgtctcgc

SEQ ID NO: 29 - DNA, 108 bp, Homo sapiens
  chr1:44873065-44873173
  hyper
ggctcttcctgcaaaggggaatgagcagaggggggaaaggcagaaagagcgtcgaggaagagcggtgctggcgtcttccgtgccgatccctcctggcccgcagagacc

SEQ ID NO: 30 - DNA, 281 bp, Homo sapiens
  chr1:44873509-44873790
  hyper
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttggg

SEQ ID NO: 31 - DNA, 94 bp, Homo sapiens
  chr1:44883121-44883215
  hyper
tggcttggcttggctcggcgcgccgctcgcctggcggctgggctcgctgtagttgtgctcccgctcttcccctgccctcgctccacgccgcgcc

SEQ ID NO: 32 - DNA, 95 bp, Homo sapiens
  chr1:44883751-44883846
  hyper
cgccgtctgagcagaagagagtgggaaccggggtgacggataaggggggggcgcccacgcgacgtcggggtgcatgggagcgcgcgggaggcgct

SEQ ID NO: 33 - DNA, 229 bp, Homo sapiens
  chr1:46956387-46956616
  hyper
ttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 34 - DNA, 155 bp, Homo sapiens
  chr1:46956684-46956839
  hyper
cgacaggccaggggccctgatggactgtgcagggtcccgggcaccaccggctgaactttctggcggtcacaaattcccggaacctgcgcaggggcttcgttggcactggtggttcacttaaggagcttgagggaaacctcctcttccccaaattc

SEQ ID NO: 35 - DNA, 314 bp, Homo sapiens
  chr1:46956840-46957154
  hyper
caccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgag

SEQ ID NO: 36 - DNA, 326 bp, Homo sapiens
  chr1:47009560-47009886
  hyper
aggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggca

SEQ ID NO: 37 - DNA, 126 bp, Homo sapiens
  chr1:47009910-47010036
  hyper
cgcctcccgccacccggaacccctctccttcaagcgttgaccgccgacccacagctccccttcaacccggggcgagcggggttcttaccatacacctcccctctccgctcggttccatccttctcc

SEQ ID NO: 38 - DNA, 28 bp, Homo sapiens
  chr1:47010104-47010132
  hyper
cgtccgcactttccgagagccaggcacg

SEQ ID NO: 39 - DNA, 226 bp, Homo sapiens
  chr1:47696295-47696521
  hyper
cagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcc

SEQ ID NO: 40 - DNA, 345 bp, Homo sapiens
  chr1:47696620-47696965
  hyper
cgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggagcctcccactcaccaacgaacccctcaaacacctaggcacaggcgggcctccgggcagagcagccgccgaccgggcgctgtccgcccacccaagccaacaactggctcccgaatacatcataatttggaataaaatgtgaaatcc

SEQ ID NO: 41 - DNA, 44 bp, Homo sapiens
  chr1:47696986-47697030
  hyper
cgcccccaccagcgcctcgatctctcgctcgccctccccccact

SEQ ID NO: 42 - DNA, 606 bp, Homo sapiens
  chr1:47697341-47697947
  hyper
tgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcc

SEQ ID NO: 43 - DNA, 89 bp, Homo sapiens
  chr1:47698006-47698095
  hyper
cgaggcgcgccggggccgtgtgcgccgcagagataaggcactgccgcgggtccgcccgcccccgataagcgcctcggccattatgggcc

SEQ ID NO: 44 - DNA, 600 bp, Homo sapiens
  chr1:50882808-50883408
  hyper
atctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgct

SEQ ID NO: 45 - DNA, 15 bp, Homo sapiens
  chr1:50883962-50883977
  hyper
ccatccactgagagc

SEQ ID NO: 46 - DNA, 333 bp, Homo sapiens
  chr1:50884020-50884353
  hyper
cgcagcctctgaattctcatgaattcccagccttttggaaagggggccgggtgaggctggaagagggatccggaggtaggagatgaggacccaggccgcgcaccccctccgagaacacctgcacctgtctgtagctgctccccctttgctcagccttccccacccaccctcctaaacaaaacccaaaaaccaccttagagtgagaagacgcccagccagggcgcagagagagcgctgggcgaagaggggtcgatggcccgcgggaacagggctggggttcctgtttggggaccggccggctgccaggcccctcgccctactgcttctccggag

SEQ ID NO: 47 - DNA, 198 bp, Homo sapiens
  chr1:50884690-50884888
  hyper
cgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggc

SEQ ID NO: 48 - DNA, 634 bp, Homo sapiens
  chr1:50886451-50887085
  hyper
caaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 49 - DNA, 60 bp, Homo sapiens
  chr1:50887175-50887235
  hyper
gggcacgctgggcagctccgagcgcagctccatgacaggacctgacgggaaagaaggtgg

SEQ ID NO: 50 - DNA, 322 bp, Homo sapiens
  chr1:50891148-50891470
  hyper
aagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgc

SEQ ID NO: 51 - DNA, 504 bp, Homo sapiens
  chr1:54203828-54204332
  hyper
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaaca

SEQ ID NO: 52 - DNA, 29 bp, Homo sapiens
  chr1:58715503-58715532
  hyper
cggccacaacttgggcggctctgtgcggc

SEQ ID NO: 53 - DNA, 322 bp, Homo sapiens
  chr1:58715533-58715855
  hyper
gccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccgg

SEQ ID NO: 54 - DNA, 15 bp, Homo sapiens
  chr1:58715978-58715993
  hyper
cgagcgggctccgct

SEQ ID NO: 55 - DNA, 342 bp, Homo sapiens
  chr1:63539509-63539851
  hyper
aaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaag

SEQ ID NO: 56 - DNA, 306 bp, Homo sapiens
  chr1:63784987-63785293
  hyper
ctctcctgggaagttcgcttgttgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctc

SEQ ID NO: 57 - DNA, 149 bp, Homo sapiens
  chr1:63785618-63785767
  hyper
ggacccagcatcagatggtaacactgattgaacaagagattagcacaatagatctctaaccgaggggaagcgttgcttttcacgctacgcgccgtaattaatggtatgaatcaattaatttgacttttattgtgtcgaaggaaaaaagc

SEQ ID NO: 58 - DNA, 251 bp, Homo sapiens
  chr1:63786078-63786329
  hyper
gccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctg

SEQ ID NO: 59 - DNA, 280 bp, Homo sapiens
  chr1:63789217-63789497
  hyper
cctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttc

SEQ ID NO: 60 - DNA, 31 bp, Homo sapiens
  chr1:63789728-63789759
  hyper
ggctcacagctcggcccgggcctgcagctgc

SEQ ID NO: 61 - DNA, 584 bp, Homo sapiens
  chr1:63795350-63795934
  hyper
agacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccac

SEQ ID NO: 62 - DNA, 218 bp, Homo sapiens
  chr1:63795935-63796153
  hyper
gtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggg

SEQ ID NO: 63 - DNA, 462 bp, Homo sapiens
  chr1:66998790-66999252
  hyper
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttct

SEQ ID NO: 64 - DNA, 378 bp, Homo sapiens
  chr1:67217965-67218343
  hyper
agttcccctccagctcgccgccaacccaggacgcagcccggctcagagtgacccccagtgggcagtgaagatgagatcctctacatccttagggcagctcagagggccactcagcggccaagtccggccggggagggccgagggctctgtttgaggtcaccctggagaccggcctcagagtccagggagagtgcgcgggcggccgccggctgaatgaagcctgggacgcgggagccgcgccgcgcgcagtgtctgcagtgccggaggtctgggaggctccgggcgaagcctccctgctgcaggtagggtcgcctctctctgcagcgcgtctggaccccaaaggaaggatagggggcaagggatcggccctttgttgag

SEQ ID NO: 65 - DNA, 151 bp, Homo sapiens
  chr1:75596708-75596859
  hyper
agccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 66 - DNA, 418 bp, Homo sapiens
  chr1:75596929-75597347
  hyper
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccc

SEQ ID NO: 67 - DNA, 218 bp, Homo sapiens
  chr1:77334168-77334386
  hyper
cgcccgcccgcagcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggac

SEQ ID NO: 68 - DNA, 119 bp, Homo sapiens
  chr1:77334408-77334527
  hyper
cggagtggcggaccacaaggtgacagcatgcccgccagcccgctcgccactcagcctggggatcccgcacacctgagccttccccctttcccggggctgggaggcgctgtgagtaggtg

SEQ ID NO: 69 - DNA, 417 bp, Homo sapiens
  chr1:91177840-91178257
  hyper
ggattgcagtgccttcgctgcaatgttttcaccgggggtgtggggtgcctgggatggggctggacaatggattaagggctggctgtcccccaggccctaggccgtggatgagcacacggggcaccaggggccgctgcagctggggatggggtgctggaggagtccggtacatgctgctgtacatggcagcggcagccgccgccgccgtagtgctgtccatgctgcccagcaggcttgggtgatagaaataaggcgatggaaacatcctctgcagcgccgagtagttccctgcctcggccagcaactccaggcccaccgctgtctgccgcttccacttggtcctgaaagaaagcgggtgtgcaggcacccagcagctgtgggcatggtccaggcaccaagacccggccccttctctgg

SEQ ID NO: 70 - DNA, 241 bp, Homo sapiens
  chr1:91181807-91182048
  hyper
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagag

SEQ ID NO: 71 - DNA, 481 bp, Homo sapiens
  chr1:91188983-91189464
  hyper
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctc

SEQ ID NO: 72 - DNA, 269 bp, Homo sapiens
  chr1:91190137-91190406
  hyper
ttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtcccta

SEQ ID NO: 73 - DNA, 233 bp, Homo sapiens
  chr1:91192344-91192577
  hyper
gctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcc

SEQ ID NO: 74 - DNA, 54 bp, Homo sapiens
  chr1:91192681-91192735
  hyper
cgactctgggccaggccccaaggaccgccccggcctctccggctttgcggggag

SEQ ID NO: 75 - DNA, 242 bp, Homo sapiens
  chr1:91195148-91195390
  hyper
cgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctct

SEQ ID NO: 76 - DNA, 450 bp, Homo sapiens
  chr1:108506627-108507077
  hyper
cttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccgga

SEQ ID NO: 77 - DNA, 228 bp, Homo sapiens
  chr1:108507148-108507376
  hyper
cgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctccttcaggttgatggagtgcgcccggaggttgttaagcagctggcagagcaggactccat

SEQ ID NO: 78 - DNA, 113 bp, Homo sapiens
  chr1:108507494-108507607
  hyper
cgacggctccgggacgcggctgggccggggcgggcggcaaggatgcggccgccgccgccgccgccgcggttcctccgcgccccgccgacgccaacagccgccggccctttccc

SEQ ID NO: 79 - DNA, 550 bp, Homo sapiens
  chr1:108507657-108508207
  hyper
cgctaggctcggctccggtcccggcccgggtgcgccgcgacccggccgccgctgcagcgagtcccgcgcgctctccgtgcgccccggccggctcggcggcggctgccgcgcacaggcttccgactccagcgcccggcccgccactgagcatgcccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggctgaatactgtaatacgatggggtcccccaggaccccctaaacaacaaatgctcaaaggagcgacggattaattggggcacccagactccccagagcaatgaaaaaagtgcctagagcatcagtagagcacggcgctgaaagttttagagatcgtc

SEQ ID NO: 80 - DNA, 340 bp, Homo sapiens
  chr1:108508208-108508548
  hyper
ccccctcgccccttgcagctctatcccctccattctctatagctgattcctcagcctattcctcctagttgcccctagtggtgttttggcaccctcaaagtgagtgagagtgcgtgtgtggagacgcctgcggaaaccgccccgatccctgagcctatttcctcgcgaggtgattttcacttggagctggtttgcccctgcactgtcaggctcggaactgtttgccgttgctgttctggcccttttgctgaccccacaaaaacctgcttgagaaaggcctgtgccacggtgctagactgcgcatgcgtcggcgactggcggccgggtttgagagcaaagc

SEQ ID NO: 81 - DNA, 38 bp, Homo sapiens
  chr1:108508549-108508587
  hyper
cgttagccctgggcagctcctgccgggctgttctggga

SEQ ID NO: 82 - DNA, 312 bp, Homo sapiens
  chr1:110610586-110610898
  hyper
gtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 83 - DNA, 232 bp, Homo sapiens
  chr1:110611045-110611277
  hyper
cgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatc

SEQ ID NO: 84 - DNA, 80 bp, Homo sapiens
  chr1:110611434-110611514
  hyper
cgctttctttggttttctttctcggtatttcgttgtcaaggccacccttgccgtcggatcccggggtgctgggtttctcc

SEQ ID NO: 85 - DNA, 141 bp, Homo sapiens
  chr1:110611653-110611794
  hyper
gctgagccaggccgggtacctgtctctggcggtgctcaccgcactgcgcggcctctgccgtctggctgggatcagaggagccaggccaactgcttctcattaagtcccaactgtggtttttatcaggaaagcctctttcaa

SEQ ID NO: 86 - DNA, 595 bp, Homo sapiens
  chr1:110692902-110693497
  hyper
gggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacg

SEQ ID NO: 87 - DNA, 433 bp, Homo sapiens
  chr1:110693736-110694169
  hyper
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcg

SEQ ID NO: 88 - DNA, 239 bp, Homo sapiens
  chr1:111216734-111216973
  hyper
ccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 89 - DNA, 381 bp, Homo sapiens
  chr1:111217194-111217575
  hyper
gccacagccgccttgaggcggggcccctccaccatcggccacctccggctccagcaggtggtccccgggcaccacggtcatgtcgggcggcagctcgcggcctgcggcgggctccgcgtagccgtggttcaccagcgtgtgggcaccgccgctgctcgctgggcgctgaggagggtgggcgcggtggcgggctgagggcggcggcggcgagcgcagaaggctgaggcgctcgtccatgcggcggggaagaggcggcagcggtgaggccaggtcgctcctcctcgcgctccccgccctttcgccgcctccgcccccgagccgagcccaccgcctgttgcagccaaagccgcgatgctctgtctgggtctggcgcggtcagcc

SEQ ID NO: 90 - DNA, 136 bp, Homo sapiens
  chr1:111217576-111217712
  hyper
ggctcccgcacggggacgcctcctccctccttctcgcgctctccgccccctcccctgcggggcgcgcgcccgcctccgcgtccccttaggattcccgcccaccgcgcgggcgcgcgtcccgctctcgggggcagcc

SEQ ID NO: 91 - DNA, 179 bp, Homo sapiens
  chr1:111217713-111217892
  hyper
ccgggcctgcatttcttgcagccctcaaggcccctcggtgtcagcgaaagagccctcatgttgtacctcggcgccccgcgggaatgcccacccagcagagccggcccacggggagtcaggctgccggcccgggcccctaggctccgcccgcttctggtcagcgcccctcgcccccggcc

SEQ ID NO: 92 - DNA, 93 bp, Homo sapiens
  chr1:111217923-111218016
  hyper
cggcccgtgggccgggagagctcccgccgcggccccgcgggcgccggccccctggcctccacacccctaggtacagcccggggagggcaggcg

SEQ ID NO: 93 - DNA, 285 bp, Homo sapiens
  chr1:119551013-119551298
  hyper
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgt

SEQ ID NO: 94 - DNA, 15 bp, Homo sapiens
  chr1:154474763-154474778
  hyper
tgctctttcctcctg

SEQ ID NO: 95 - DNA, 81 bp, Homo sapiens
  chr1:154474987-154475068
  hyper
cggggtgagcgccatggcagaggcgggtcgggctgcgagctctggagaaaggggcggcggccgcacgtgcggatcggccgc

SEQ ID NO: 96 - DNA, 173 bp, Homo sapiens
  chr1:154475371-154475544
  hyper
gtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggtatggcttgtcggccccaggtcccgggatgccaggcga

SEQ ID NO: 97 - DNA, 662 bp, Homo sapiens
  chr1:156357865-156358527
  hyper
ttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagg

SEQ ID NO: 98 - DNA, 714 bp, Homo sapiens
  chr1:156390135-156390849
  hyper
ggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaa

SEQ ID NO: 99 - DNA, 425 bp, Homo sapiens
  chr1:156863061-156863486
  hyper
cggtgcccgggaggggtcttaataagatcacggttgctgggcagcactggacagtgcccgacgtaggcgatctcattgattccttcccacaaccccactttgcagataggaaagctgaggcacgagagggtaagtaacccaggccgcacaacgaggggaagctagggagggactggggccctgggcccctgcgctgacctcccctcctcatccccttcttatccccctctgctcctggcccaggccgcgcagagtcggcctctgtgatcccacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcag

SEQ ID NO: 100 - DNA, 69 bp, Homo sapiens
  chr1:156863640-156863709
  hyper
cgcgccccctggcaggggaggcccggtggtgcggccccggagaccaccctgccccggggaaagggcttg

SEQ ID NO: 101 - DNA, 278 bp, Homo sapiens
  chr1:169396357-169396635
  hyper
agactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctcc

SEQ ID NO: 102 - DNA, 53 bp, Homo sapiens
  chr1:169396636-169396689
  hyper
cggcagccaggaccacactgccatggcaacagcgtgcctctgcgtcctccatc

SEQ ID NO: 103 - DNA, 193 bp, Homo sapiens
  chr1:169396730-169396923
  hyper
cgcatgcaatatcctcagaccaccgacccctcccggcacccatcccggtgcttgcgaagggccagtgaagctgaggtttctaaggggacgactaaggaatccacgcatcactaacgttatagagactcgcgaagtgccgctgtgttggttgtgaaatttccctcttgtagctgtctctcgtcagatttagaat

SEQ ID NO: 104 - DNA, 144 bp, Homo sapiens
  chr1:170630458-170630602
  hyper
ctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 105 - DNA, 207 bp, Homo sapiens
  chr1:170630603-170630810
  hyper
acggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatggg

SEQ ID NO: 106 - DNA, 595 bp, Homo sapiens
  chr1:171810200-171810795
  hyper
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaa

SEQ ID NO: 107 - DNA, 62 bp, Homo sapiens
  chr1:197879599-197879661
  hyper
gtatagaatgcatgtcgttaccaaatacctagaacggtattggaccgcaaagaggttaaacc

SEQ ID NO: 108 - DNA, 508 bp, Homo sapiens
  chr1:197879716-197880224
  hyper
cgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagct

SEQ ID NO: 109 - DNA, 160 bp, Homo sapiens
  chr1:197886907-197887067
  hyper
cttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggag

SEQ ID NO: 110 - DNA, 311 bp, Homo sapiens
  chr1:197887146-197887457
  hyper
cggcggtagccgggcacccctgcgccctctgttaaaccaagccgactccctggccggtggagaaccggagcggcgggtcgtagagacgtccgcttgagggtggcgggtgagttttctcccgtccacctatgcctacagggctaagaaacggtcgtttttctgaatcgaaatgtctgcagctggctatcctccgtcgcagctgattccgaaagagcagggagaggaactgggaggaggtgggatggggggtggtggcattctcttctacagacctcaaggttcccttgattccggggcaggcgtctccccgg

SEQ ID NO: 111 - DNA, 416 bp, Homo sapiens
  chr1:197887706-197888122
  hyper
cgtttagcgccaggacccggcgggtgtcatgtgtagggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatcagctgggttttgggtccggccaagtagcccaactggtgaacgtgtctatatttgtaacactcattcagtgc

SEQ ID NO: 112 - DNA, 45 bp, Homo sapiens
  chr1:197888180-197888225
  hyper
cgtggggaagatcaacccatttctgctagtcgtgagggaaatgtc

SEQ ID NO: 113 - DNA, 299 bp, Homo sapiens
  chr1:200009750-200010049
  hyper
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggt

SEQ ID NO: 114 - DNA, 376 bp, Homo sapiens
  chr1:205312536-205312912
  hyper
gcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 115 - DNA, 407 bp, Homo sapiens
  chr1:207669381-207669788
  hyper
ggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccc

SEQ ID NO: 116 - DNA, 232 bp, Homo sapiens
  chr1:207669828-207670060
  hyper
cgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagcc

SEQ ID NO: 117 - DNA, 810 bp, Homo sapiens
  chr1:215255060-215255870
  hyper
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatggg

SEQ ID NO: 118 - DNA, 110 bp, Homo sapiens
  chr1:223936643-223936753
  hyper
tccggcggtcccgcccggcagtaggacagagggagcgagggagtccgggaggaagggagagcgggtgcggccagtctgacggttgctgtgtttgcagatcaccagcgccg

SEQ ID NO: 119 - DNA, 62 bp, Homo sapiens
  chr1:223936995-223937057
  hyper
cgggcgccgggtgcgccgcgctgccacctggtggccgcagtggccggcgccaggggccctgg

SEQ ID NO: 120 - DNA, 62 bp, Homo sapiens
  chr1:224804625-224804687
  hyper
ccctccagcgactctcgacacacgttttcctgtcttcgccggagggccgggtctggggtcgc

SEQ ID NO: 121 - DNA, 270 bp, Homo sapiens
  chr1:224804846-224805116
  hyper
cgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgc

SEQ ID NO: 122 - DNA, 555 bp, Homo sapiens
  chr1:224805197-224805752
  hyper
cgtcccgggtcccgggcgccggggagtggcggctacaaccacaactaaccccttcctctcccgccccgtcctctcctgccggcgggaggcgaaggagaagcgccgccgtcggtcccggcaattagtcaagtagctataataactaaacatttaaaatgtcagcatctgtggtgggttgcatttagatataattggagacaaagtggaaacacgacgggagcgccttgtaagaggtagggagaagccgagcccacggagaggaaggagaccaggcgatgggggtcgaagtggaaggcggtgggggaaaggcgagaaggagaagagcaaggaggcgagggagactgggaagggcaggcatcattaaggccatggaggaaagtcacgaagagagaccgtggagagcgacgacggtgtcctccatctgccctcttggcgtctgaagtccgactcctgaagaccccctgcaggtggcgaacctccgctaggcccccagcgtccccagcccacacaagcttcctgtcacccttcccggggctacgccaggtggagggcagc

SEQ ID NO: 123 - DNA, 18 bp, Homo sapiens
  chr1:224805848-224805866
  hyper
cgccggtcctctcaaaga

SEQ ID NO: 124 - DNA, 1554 bp, Homo sapiens
  chr1:228194949-228196503
  hyper
agcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggc

SEQ ID NO: 125 - DNA, 107 bp, Homo sapiens
  chr1:228633813-228633920
  hyper
gtcgcaaccacccagcgctgggaacctgagcctgcacaacccactagaaagcacccgtgaccgtcccctgcgcccgttatccctgcgccccgcacccctgtatcccc

SEQ ID NO: 126 - DNA, 29 bp, Homo sapiens
  chr1:228633921-228633950
  hyper
gcttctctgcagctgtacaccctgcactg

SEQ ID NO: 127 - DNA, 157 bp, Homo sapiens
  chr1:228633983-228634140
  hyper
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggac

SEQ ID NO: 128 - DNA, 470 bp, Homo sapiens
  chr1:228651432-228651902
  hyper
gagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgc

SEQ ID NO: 129 - DNA, 247 bp, Homo sapiens
  chr1:228652206-228652453
  hyper
cgcttcttgccgtccttcttctgcgccttggtaatggccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtc

SEQ ID NO: 130 - DNA, 34 bp, Homo sapiens
  chr1:228652508-228652542
  hyper
cgcgccggagctgaggttgcgcatctttgttcaa

SEQ ID NO: 131 - DNA, 140 bp, Homo sapiens
  chr1:229542813-229542953
  hyper
catgctgaggttggtcgcttgtttcattcactgtctcctacgcagtccatgccacgggggataagtttttcacaagtggctttttttccccacagtgaagagacgtggcctgggtctggagttcctcaaccggcaaaata

SEQ ID NO: 132 - DNA, 124 bp, Homo sapiens
  chr1:229543220-229543344
  hyper
cgagagggagctctggtccccgaggggctgtcccgggagggagcgaggtggggagggggagcaggccctgccccgagcaccccgcggactgagcgtctggcgtgcacggcggaggggttaccgc

SEQ ID NO: 133 - DNA, 86 bp, Homo sapiens
  chr1:229567191-229567277
  hyper
cccattgagaagattcgtcgtcctgagaagtcgcgtgctggaggtggagtgtgtctagaagcatttgcggtggacgatggaagggc

SEQ ID NO: 134 - DNA, 624 bp, Homo sapiens
  chr1:229567369-229567993
  hyper
cgctccggcggggcgatgatctgcaagacagcgcgtgaggtggggagacctcaccctggagcccaccccgccgacagcccgcgcaggccaccacccaccttgatcttcatggtgctgggtgccagcgcggtgatctctttctgcatgcggtcagcgatcccagggtacatcgtggtgccccccgacatgacgttgttggcatacaggtccttcctgatgtcgatgtcacacttcatgatgctgttgtaggtggtctcgtgaatgcccgccgactccatacctggggaccgcggcggggagcgtgagcagaagctcggggcgccgggggccggcggggcctgggggccggggcgagggcgagcggggctcaccgatgaaggagggctggaagagcgtctccgggcagcggaagcgctcgttgccgatggtgatgacctgcccgtctggcagctcgtagctcttttccagggaggaggaggaggcggccgtcgccatctcgttctcgaagtccagggccacgtagcacagcttctccttgatgtcgcgcacgatctcgcgctcagctgcggagggcagaagcaggagaggagccctcactcaggggccgccgccggccctcccgcc

SEQ ID NO: 135 - DNA, 193 bp, Homo sapiens
  chr1:229568157-229568350
  hyper
cgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggcca

SEQ ID NO: 136 - DNA, 49 bp, Homo sapiens
  chr1:236849457-236849506
  hyper
gtccctcccctggctcgcgatcacccacccgggacaccgacggaccccg

SEQ ID NO: 137 - DNA, 224 bp, Homo sapiens
  chr1:237206511-237206735
  hyper
ggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggct

SEQ ID NO: 138 - DNA, 626 bp, Homo sapiens
  chr1:240254860-240255486
  hyper
gcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgc

SEQ ID NO: 139 - DNA, 672 bp, Homo sapiens
  chr1:240255487-240256159
  hyper
ctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggac

SEQ ID NO: 140 - DNA, 116 bp, Homo sapiens
  chr1:248020515-248020631
  hyper
cggccgggagcgcagccctccgggaggcgggtcatggcctgggcgccgcccggggagcggctgcgcgaggatgcgcggtgcccggtgtgcctggatttcctgcaggagccggtcag

SEQ ID NO: 141 - DNA, 341 bp, Homo sapiens
  chr1:248020956-248021297
  hyper
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtg

SEQ ID NO: 142 - DNA, 249 bp, Homo sapiens
  chr2:468423-468672
  hyper
ggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaact

SEQ ID NO: 143 - DNA, 37 bp, Homo sapiens
  chr2:25438835-25438872
  hyper
acgacaaggtccgggcgcccagcagaacggcccggct

SEQ ID NO: 144 - DNA, 222 bp, Homo sapiens
  chr2:25439138-25439360
  hyper
ggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcatcggt

SEQ ID NO: 145 - DNA, 179 bp, Homo sapiens
  chr2:26407743-26407922
  hyper
gacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgc

SEQ ID NO: 146 - DNA, 279 bp, Homo sapiens
  chr2:30453784-30454063
  hyper
cggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccct

SEQ ID NO: 147 - DNA, 158 bp, Homo sapiens
  chr2:38302718-38302876
  hyper
ggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataa

SEQ ID NO: 148 - DNA, 38 bp, Homo sapiens
  chr2:39187200-39187238
  hyper
ggagccgctgggcaacgtggagcgctccctgcgcgccc

SEQ ID NO: 149 - DNA, 63 bp, Homo sapiens
  chr2:39187544-39187607
  hyper
gcaaggccaagccgctgagccgctctctcaaagagttcccgcgtgcgccgccagccgacggcg

SEQ ID NO: 150 - DNA, 392 bp, Homo sapiens
  chr2:40678497-40678889
  hyper
cacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcggacacccagaaaaatgtgcaggcgcgcacacaccacatcacacacacaca

SEQ ID NO: 151 - DNA, 137 bp, Homo sapiens
  chr2:40678949-40679086
  hyper
aagcagagggaagtgtagccttatgagcagcaaatggaaaatagttcttggtctctgactaaatgccttctgcctgtccatcataagatcctacctggtttggggagtgtgaatggattcttcctccgttcctccac

SEQ ID NO: 152 - DNA, 432 bp, Homo sapiens
  chr2:40679087-40679519
  hyper
ctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggc

SEQ ID NO: 153 - DNA, 85 bp, Homo sapiens
  chr2:40679520-40679605
  hyper
agcagctttttcgatttcctgccggctctcggccccgcagtgcgttgtggccgcgcgctagcgctgtctctcgcacccagcccat

SEQ ID NO: 154 - DNA, 119 bp, Homo sapiens
  chr2:45028940-45029059
  hyper
tccttttaattgtgacggtgcggccgcttgggcgtgatcccttggctggggctgcagggggcccgtcctccaggggcgcagagggaaggaccagcgtttccaagccgggctctggccgc

SEQ ID NO: 155 - DNA, 184 bp, Homo sapiens
  chr2:45029183-45029367
  hyper
cgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcc

SEQ ID NO: 156 - DNA, 86 bp, Homo sapiens
  chr2:45155125-45155211
  hyper
ttgcttttggtgtgccggcaacttttggttgttgctgctgttgccagtgcgcttagcagagtaggaagctcgaagcgcaaagcaac

SEQ ID NO: 157 - DNA, 636 bp, Homo sapiens
  chr2:45155355-45155991
  hyper
cgcagttttgcaaatccttttccctctccccatgcctcgcggtttaagaccacgcgatttcccaaaaagaaaaactcaaaagatgccaggcgccgggctggagtcacttagagccagctctggctgctcctccgcctccccgacccccggccgccgctccgccctgcccctcgcgcctcgaccccttctcccgaaactccgtcctctccgccgaggggctgccttgcccccaacccaccccccgcgtggagaataaacacagttgacatcactcttataatctttatttaaaactgtttccaaggttacaaattgccgagcctcgtatgcaacaggttcctccaaagcggtatcattacagattaactgtaatgtgtaggattagaataaaagcataagggattaggtaaaagggcgacgctccagacataacgcccgagcgcatctcgactgagtcagcctagggagactgcgaaggcgcagggtgtcggggcgccacggggccgcaaagccggactcggttcctccgctcccggccctggccccggccccagagcggtcgggacagcggcgccggaaggccaacgcggccgaaggtttcggagccaggcttcccgggcgtcaggggctagggac

SEQ ID NO: 158 - DNA, 820 bp, Homo sapiens
  chr2:45155992-45156812
  hyper
ggtccccggagctggggaagatgaggggccgagaggccgtggaggcggaggacgcgggcaagccacggcccggctgggagcttcgggaagcgccgcgcccgggacgcggtctccgggcggggcgaagcgcagggaaggcggcgagggggtccccacacccgcacggggcaccgggtttgtccatgtgggtgacactgccttcaaggcccaggcccgatggggcccttcctggcgtcctcctcacccccactccgccgcgcctcccctgtccagctggggctggggacagcggcaggggctgggcagccgcgcaggccgcccgcacccttccgagcccaggcctcgggccttcgccgcccgcccaggccgtgcgccctattggaccaccttccccccggccttcgcctgcccctctcgcgccaggaaggccctggagctccctctccccctcacaccgcttcctgcggggccagggctcgccgtgctggccccatttggactcaggcctgacctgggccacggcctcaggccgctgacgcagccccgagggctgtttgcgtgttggggtggagggcgcggggctggaaaaacaaacagggcgggggcgcggaggtttggggtgggggccgcagggggctggaaggaagtgcgcagtgtggcgagagcgcgaacaaagccctctccggagccccgtcacccctcggtgaccccaggcccgccccgctgagccgcggggctcccgggcctcgcctccgagcaggccgcaccgcccggtgggcgcacgtcaggcctccgcggccgcccgggccagtgctcccct

SEQ ID NO: 159 - DNA, 89 bp, Homo sapiens
  chr2:45156832-45156921
  hyper
cgcggccggccccgaaggcgcgagggacagcgcggccggcggtggagcctcactcaggcacggagcccacagagcgaggctgaggagga

SEQ ID NO: 160 - DNA, 96 bp, Homo sapiens
  chr2:45157254-45157350
  hyper
gtatgggatttttgccgtcggagcacctcgtatccggcgcgcgggcccagtgtgggactgcggctgggagcccgggccctccgggagtgaagatac

SEQ ID NO: 161 - DNA, 240 bp, Homo sapiens
  chr2:45171324-45171564
  hyper
gtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggct

SEQ ID NO: 162 - DNA, 43 bp, Homo sapiens
  chr2:45171836-45171879
  hyper
cgcgcagacaccggcacctccatcctctcggtaacctccagcg

SEQ ID NO: 163 - DNA, 54 bp, Homo sapiens
  chr2:50574631-50574685
  hyper
ccctccattcagccccggccggctcgcccgctagcgccagcctcccccgggcag

SEQ ID NO: 164 - DNA, 121 bp, Homo sapiens
  chr2:50574738-50574859
  hyper
cgcctcctgacacttacgcccggcgaggggttcagagggaagagtgcgcccttctgaaggaagtgggaatcgaacggcggaaaggcagctgagaagaagatgcagacgaaggagtaaggga

SEQ ID NO: 165 - DNA, 147 bp, Homo sapiens
  chr2:63275877-63276024
  hyper
ggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtg

SEQ ID NO: 166 - DNA, 699 bp, Homo sapiens
  chr2:63280952-63281651
  hyper
gagaggggcagccctcgaatcttggagacactggcttctagtcgcacatctgcactttctcccacctgtggcctctcaggctcggccgcccgagggagtttcttttattcccagttcggctttcttttgcgaaggccgagatctgggcctgccaggggcctgcccgagtcctctatcgcgggtccacgtggccaccaatgacccgcggcgcccccgcgtgtccccgcagccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtgcgcactccccgggctccagggtctgggtaggggagctgaggctgctcggggaaggtctaggaaggctcttgagtagttcttgaggagaccatcctgtgggggtgggcttacagactgggcagccgctctcggactccccctagcgctgggccccagccaggaaagggggcaaaagttaaaggaaatggcttagagccctggattccgcctttagccctagggcgccttcggtgtcggtatcgaaagtactttttagaattgccggaggactagggaagctcccgaatgtaaagcgccctgcgggcctgacacttg

SEQ ID NO: 167 - DNA, 493 bp, Homo sapiens
  chr2:63285117-63285610
  hyper
gtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttc

SEQ ID NO: 168 - DNA, 227 bp, Homo sapiens
  chr2:63286358-63286585
  hyper
gcactggcctgggcacccgggctgcagggccttttgggccctcccctcagtgaccctgcctgtagcggccccagggccgctttggctcaggcagcagctgccaatgccgctcgaggcccgcggctccctgaggcgagctctgcggggcccagcagtcctcttggctgctaaatggaacgaaaccaggagacccggctttgcactcgtttggacaactgtgtggcctc

SEQ ID NO: 169 - DNA, 55 bp, Homo sapiens
  chr2:63286693-63286748
  hyper
cgggaggggcagatgcgacccctgggccggcccctcgggggcgtctagaagcttc

SEQ ID NO: 170 - DNA, 236 bp, Homo sapiens
  chr2:63287082-63287318
  hyper
ggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaac

SEQ ID NO: 171 - DNA, 58 bp, Homo sapiens
  chr2:66808576-66808634
  hyper
cactgtcccttttctcgtctccccgcgcacctccccagacgccctgccggggtggctc

SEQ ID NO: 172 - DNA, 665 bp, Homo sapiens
  chr2:66808726-66809391
  hyper
cgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaact

SEQ ID NO: 173 - DNA, 268 bp, Homo sapiens
  chr2:68546249-68546517
  hyper
cgcgaggccagaggcccttgagaggctcgggctgtcctgggggcctcagtcctctgcctgtaccccatgggggaccctgctgccaccaggcgccccgcactcactcgacctgcagcgtgctgggtttaatcttcacctcaaccttgtaggaggagccggtgagcagcttgatggtgcggttctggccgaagcgctgcccgtccaccttgtaaaagaccgggccgtcattaggctggatgcgcagcgcgatggagaggcgcacgaggcc

SEQ ID NO: 174 - DNA, 361 bp, Homo sapiens
  chr2:68546552-68546913
  hyper
cggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatcccc

SEQ ID NO: 175 - DNA, 139 bp, Homo sapiens
  chr2:73147389-73147528
  hyper
cctcttggaaattgccgccgcttcctgagccatcagtcccagcgggtacgttatcgagtagcacaaacagttggatttttccctcaagaaccgagtctggacgcggagatggagccaagtgtggctgcattttcggacc

SEQ ID NO: 176 - DNA, 101 bp, Homo sapiens
  chr2:73147966-73148067
  hyper
cggtactgtttccccgagatcaggaactttccgggtctaggagcaacgcctggagggggctgtagagacccagccccccgggacccgcaactacaatgggc

SEQ ID NO: 177 - DNA, 19 bp, Homo sapiens
  chr2:73148174-73148193
  hyper
cgtccggccctgagcccct

SEQ ID NO: 178 - DNA, 271 bp, Homo sapiens
  chr2:73430485-73430756
  hyper
cctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgct

SEQ ID NO: 179 - DNA, 731 bp, Homo sapiens
  chr2:73518261-73518992
  hyper
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggg

SEQ ID NO: 180 - DNA, 324 bp, Homo sapiens
  chr2:74742324-74742648
  hyper
ggctcacgggtgaggttgtctgacccctccagcgtcacgcccgactctgaccccgtctcctcatttcttagctttctgctccaactcaaggacccctttcacacctcccactagatcctcccaggggatcctcccccaactcaaatctctgggtcctgcctccgagaggtgatggggagggagctgccgtcggtgcccgcgccctcctctgtagtcccactgtccacgcgtggggaggggagggtgaagttacaggggacgtctccctcgcatcccaggggaagggcctttcttggctatagggctcggctgatgcttagggcc

SEQ ID NO: 181 - DNA, 452 bp, Homo sapiens
  chr2:74742693-74743145
  hyper
cggccttctcagtggcacctcgggccaccctgcaaatcctgccctggtctttcttcctcccggtagctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggtgaggcgcggcgcgggcgagggcggactggggttcccgagcagggcctggtgagaagcgacgcggcgggcgccccgctgaccccgcgtctccctcccttaggcgccagacggcggaggagcgcgaggccgagcggcaccgcgcgggc

SEQ ID NO: 182 - DNA, 6 bp, Homo sapiens
  chr2:74743766-74743772
  hyper
cgaagc

SEQ ID NO: 183 - DNA, 69 bp, Homo sapiens
  chr2:88752716-88752785
  hyper
aacaggcccgcttggcgtgtccccttctcctcggggattctgtgattggaggaacggaaatcagtgttg

SEQ ID NO: 184 - DNA, 171 bp, Homo sapiens
  chr2:89064805-89064976
  hyper
cgctgggcatgggcttcggcccgggttgcaggaggcgtgcaccctccggccggataggcggcgcactcagggaccaggaggccatcccaggtgagccccgccagccccagccggagcccgagctgcagctgccacctgcaagtggtgctctggctgcagcggtggcaaccc

SEQ ID NO: 185 - DNA, 350 bp, Homo sapiens
  chr2:89065128-89065478
  hyper
cgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacgg

SEQ ID NO: 186 - DNA, 15 bp, Homo sapiens
  chr2:97193049-97193064
  hyper
cggcagcagagcctg

SEQ ID NO: 187 - DNA, 386 bp, Homo sapiens
  chr2:97193251-97193637
  hyper
cggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgtta

SEQ ID NO: 188 - DNA, 71 bp, Homo sapiens
  chr2:98963337-98963408
  hyper
gctgagccgtcggggcgggaggcagaaggagcagggctggctcccgctggggacgggtagggcttgcagcc

SEQ ID NO: 189 - DNA, 417 bp, Homo sapiens
  chr2:98963409-98963826
  hyper
cgaccccaccccatacatttcctcctgtcacgctgtccccggaccgccagtccgggaaggacccacttccccggctccaagtcgggagcgggcgccgcgtcttctcgagtccgcgccgcgccgggggaggttgagtcagtggcctggagggagcagggccgggggaaggcagcggcgaaggactgccccccaacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagc

SEQ ID NO: 190 - DNA, 325 bp, Homo sapiens
  chr2:98963868-98964193
  hyper
cgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctcccc

SEQ ID NO: 191 - DNA, 139 bp, Homo sapiens
  chr2:99439368-99439507
  hyper
ggccctgggggccccttctcctcatccgggagcacgggcggcgtcggctccgcttccttcgggacactgcgttctggcccgtcgcgagcagagggcgcctctgaggtggcggcggggtcagtctcggggggagtcgtgt

SEQ ID NO: 192 - DNA, 178 bp, Homo sapiens
  chr2:105458974-105459152
  hyper
aaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacc

SEQ ID NO: 193 - DNA, 361 bp, Homo sapiens
  chr2:105459902-105460263
  hyper
cggcagggggagtttgcctcccggctggctagcttcgctagactcagtcattactaaggggttgggagggggagcttgtctcttctctcctggcagagccgcgggaggcgtcggaaagtttcctaccacttgagggacgaaggtggatggatcgagagccttgtttccctgctgggatggccgaatgtaccagaagtctcgctggcgagcagcgccctcggcttccccggcaatcatcccaaacgcacacccttcccctggccgaaggaaccccaggttgcctaggaaacggccccgcggacctggcgggccctagggtggagacccgggcggggttggggggtactcgcgaatctgctgc

SEQ ID NO: 194 - DNA, 247 bp, Homo sapiens
  chr2:105460264-105460511
  hyper
ggcgcagcgttggggtgtctggtccctgcccagccggtaggccgcgtccgccgtcccactcagtggggctttgcgcccccacccatgggagttgcccgttccgcagcagagttcgaaggggaaagtgggggccacgttcccagaggaacagagttccagacctctcagggcactgatggggactccgtcggacccacgggttccgcaaacactccagaggggttcccagggccgaagatgcctcctg

SEQ ID NO: 195 - DNA, 683 bp, Homo sapiens
  chr2:118981174-118981857
  hyper
ttgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccgggg

SEQ ID NO: 196 - DNA, 203 bp, Homo sapiens
  chr2:118981945-118982148
  hyper
cgccgggccgccgggtcaccggttttccgaaagggacccggcagagacaaagtgccttcgccgctgcgataggttggttttactttgcaataaacagcccctaatgggaccgggcgccgggcggagagctcggcccggggcgcggcctttgccgcctggctctgcgggccgccccgccgggcgccaggttttggggggtggcc

SEQ ID NO: 197 - DNA, 244 bp, Homo sapiens
  chr2:118982253-118982497
  hyper
cggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaa

SEQ ID NO: 198 - DNA, 142 bp, Homo sapiens
  chr2:119616141-119616283
  hyper
ctcagcgctcccaggcgctccagtggggccgcgttccccgccagggtgggtcaggggaatactctgcctgcgccctctccgagggtccgcgcagagcgagcgcctctttaggtggggcctctggctccgacccctgctccca

SEQ ID NO: 199 - DNA, 325 bp, Homo sapiens
  chr2:132182764-132183089
  hyper
ggcgggcgcgggaggcgggcgcgggaggcgggcgcgggaggcgggcgctggctcggggggcgcgtgagagaagccgccgcgcccggcctcgctcagacgctcagacgcccgcgcctcggcccgcctcgctccccgagccgccgccgccgccgccgcctgccgaggccccctacgccgtgcccctggcagcgagaactcatccaccggggtgtccccgcagcgagcggccgctgaaggctccccgcgcccgctcctcgccgccgcctgacacggctcccgggcgccctcggccctgtccgcgcccaccgcccggctggcgcgcaga

SEQ ID NO: 200 - DNA, 371 bp, Homo sapiens
  chr2:139536937-139537308
  hyper
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcac

SEQ ID NO: 201 - DNA, 463 bp, Homo sapiens
  chr2:145273327-145273790
  hyper
acacacgcacacacacgcgtacacacacacaaaacctagagagagagagagagagagagaaaagcatcatttgtctctaatcaaaattctctcgtctttgtgttttgctccttccagcacctcacactgcgcccccagccgccccctccccgcgccgcgcagctctggggcaggccgggggcgcgcacaattgtcttctctagaggaaagttgctccaagtgggcccgggcggtccccgcgaggcgcgggctggggctgcggaggccgggaggccgggtgggcgctgcgtcccagcgcctgcctcgggagcgtctacgcggccccgcgccgggtgatcgggctgagagcgaggggagcgagaagtttcctttccgagtctgggctggcgctcgttcgcttgtttgttttcgggggttggtttctttctttttaaactcagttatcctccgtcagctcccccac

SEQ ID NO: 202 - DNA, 24 bp, Homo sapiens
  chr2:149645535-149645559
  hyper
ccgcagcaagggctgcgaccccgc

SEQ ID NO: 203 - DNA, 287 bp, Homo sapiens
  chr2:149645560-149645847
  hyper
ggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctg

SEQ ID NO: 204 - DNA, 1265 bp, Homo sapiens
  chr2:157176900-157178165
  hyper
gaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggc

SEQ ID NO: 205 - DNA, 13 bp, Homo sapiens
  chr2:157178166-157178179
  hyper
aggcccaggcagg

SEQ ID NO: 206 - DNA, 55 bp, Homo sapiens
  chr2:162275172-162275227
  hyper
cttcccccttttttccggtgccccggcttatcttcgctcccagaggtgcgaaagc

SEQ ID NO: 207 - DNA, 128 bp, Homo sapiens
  chr2:162275310-162275438
  hyper
cggcccgggcgcgcagccgggcgcacacagccacgcgcacagcgaccgcgttaacacgccacccggcgctcccctttcttcccgccggacagatggtggttttacagtccttgcacaagtaccagccc

SEQ ID NO: 208 - DNA, 128 bp, Homo sapiens
  chr2:162275472-162275600
  hyper
cggaggacactagccagcccggccgcgtgcagacgttcactttccctgagactcagttcatcgccgtcaccgcctaccagaacacggatgtaaggagacctaggggctgggggcgaggcgggcggcac

SEQ ID NO: 209 - DNA, 264 bp, Homo sapiens
  chr2:162280152-162280416
  hyper
ggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggc

SEQ ID NO: 210 - DNA, 216 bp, Homo sapiens
  chr2:162280740-162280956
  hyper
cgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttg

SEQ ID NO: 211 - DNA, 238 bp, Homo sapiens
  chr2:162283365-162283603
  hyper
attaaaatgaaaattcgtgggaggataaaactaacttgccttccctggacaattccgccactagacggcgttccgtggagttttgtctgccacataaaaaagcgaggactgaatttcctttgtgtttctttcccctcctcacatctaagaactaagtaagaggacaaaagtacaagacacggtgcatgtgtggcgagtgaagtggagcagtgcattcgtgtcatcacccacccgaccc

SEQ ID NO: 212 - DNA, 273 bp, Homo sapiens
  chr2:162283782-162284055
  hyper
ggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgct

SEQ ID NO: 213 - DNA, 22 bp, Homo sapiens
  chr2:171675361-171675383
  hyper
tgactcccagggcaccggaaag

SEQ ID NO: 214 - DNA, 131 bp, Homo sapiens
  chr2:171675522-171675653
  hyper
cggaatgaagagctaggagccccagcaggaataagagttttcagtccccggctttcgttgagccaagatctgacctcctcctttccccctgggctgtgttcaaagtctataatcagcggaaatttcgacgt

SEQ ID NO: 215 - DNA, 329 bp, Homo sapiens
  chr2:172945896-172946225
  hyper
cccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacagg

SEQ ID NO: 216 - DNA, 323 bp, Homo sapiens
  chr2:172955471-172955794
  hyper
cgggagctggccctccacctttggggggtcttttcaggcgcgcggtggggagcagagcccggaaggcagtgatctgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagaga

SEQ ID NO: 217 - DNA, 59 bp, Homo sapiens
  chr2:172957976-172958035
  hyper
ccaccctcctactcccggagcgggagccacggcggcgggcgcagcgcagccttccaacc

SEQ ID NO: 218 - DNA, 94 bp, Homo sapiens
  chr2:172964795-172964889
  hyper
gggagggcgggcaggcgggaccgggaggtcaataactgcagcgtccgagctgagcccaggggagcgggcgaggagaaagaagcctcagagcgcc

SEQ ID NO: 219 - DNA, 4 bp, Homo sapiens
  chr2:172965295-172965299
  hyper
gggg

SEQ ID NO: 220 - DNA, 116 bp, Homo sapiens
  chr2:172965647-172965763
  hyper
ggcggttctggaaccagattttgacctttgaggaaaaagacctgagcattagtggaggaacctagtcttggggcagtaggggttcgaagaggagaaaaaagaaggcagagaaaaac

SEQ ID NO: 221 - DNA, 802 bp, Homo sapiens
  chr2:172966250-172967052
  hyper
tgagtcttttggaaacgccgctgaagagccgccagctggaaactggagtagatggtgcggggtttccggactttctttggcttcccgttcactatccgaatttcaggctcaaggtcctccttctctgcaacgataaagaatcgtaagaacagcgcaacccaggggtcctggagttcccgccctcctagagggcccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggt

SEQ ID NO: 222 - DNA, 1168 bp, Homo sapiens
  chr2:175190805-175191973
  hyper
aaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcc

SEQ ID NO: 223 - DNA, 149 bp, Homo sapiens
  chr2:175192084-175192233
  hyper
cgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctcta

SEQ ID NO: 224 - DNA, 83 bp, Homo sapiens
  chr2:175193294-175193377
  hyper
gggtgggggtgggggcgggggcctgctttgatcgctccagctctgttgtaattttgtcttcgccagatagattagctggaacc

SEQ ID NO: 225 - DNA, 267 bp, Homo sapiens
  chr2:175193378-175193645
  hyper
ccagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatgtaagtcgtcctccccctctctggggacagactctagggaaggaggcagctgggcccgctccgggtggtgtccttggctag

SEQ ID NO: 226 - DNA, 35 bp, Homo sapiens
  chr2:175193808-175193843
  hyper
cgggtggttctaagctatgacgaactagaggctgg

SEQ ID NO: 227 - DNA, 90 bp, Homo sapiens
  chr2:175199465-175199555
  hyper
ccctcgccccccccccgcaagtatcccccactactcccccccacccccgcggccctagctagctgacttgactggcacgcgccgggagcc

SEQ ID NO: 228 - DNA, 8 bp, Homo sapiens
  chr2:175199921-175199929
  hyper
ggagaaac

SEQ ID NO: 229 - DNA, 181 bp, Homo sapiens
  chr2:175200260-175200441
  hyper
aaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacc

SEQ ID NO: 230 - DNA, 144 bp, Homo sapiens
  chr2:175200709-175200853
  hyper
ggggagccaggaccccccgggagcagccgcaggggacgaggctgctcacgggtgcactttgtttcttcccccacttcctcttgccctcctccttcttgctccctcccccatcccacccactctaggaagagccgcgcttcggaa

SEQ ID NO: 231 - DNA, 267 bp, Homo sapiens
  chr2:175200916-175201183
  hyper
cgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccc

SEQ ID NO: 232 - DNA, 183 bp, Homo sapiens
  chr2:175201359-175201542
  hyper
gtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgcc

SEQ ID NO: 233 - DNA, 54 bp, Homo sapiens
  chr2:175201775-175201829
  hyper
ggccggggcgagcctgcggcgcaagggcctgcacagctgccacattccgggctg

SEQ ID NO: 234 - DNA, 120 bp, Homo sapiens
  chr2:175202126-175202246
  hyper
cgaatcccccgacctcatcctgcatgactccggcgtcagtgccgcccgggcggcggcagcggcggcggcggcagcggcggcggcggcggcggcggcctccgcgggaggcaaggaagcagc

SEQ ID NO: 235 - DNA, 33 bp, Homo sapiens
  chr2:175202568-175202601
  hyper
ggagacctacaaccacaagcacgcacactcgcg

SEQ ID NO: 236 - DNA, 78 bp, Homo sapiens
  chr2:175202633-175202711
  hyper
cgagcgaagagcaatacatagaaaggctccctctttgcccactctccacctccctccaacacccgtctctttcctttt

SEQ ID NO: 237 - DNA, 119 bp, Homo sapiens
  chr2:175204828-175204947
  hyper
ccttcttgagctccccgcggccaggctgccccgctcttcttactcgagtttttcttcactttggccattttctctccccgatcaagctgttcataaccgggagccccccactccctaag

SEQ ID NO: 238 - DNA, 558 bp, Homo sapiens
  chr2:175208311-175208869
  hyper
gtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattc

SEQ ID NO: 239 - DNA, 93 bp, Homo sapiens
  chr2:175208996-175209089
  hyper
cggctccggggcagctcgggccggagggtgcgtttcttttcattccaggcagctctccgcgttcgtcccgcacatcttcgtcattactgctac

SEQ ID NO: 240 - DNA, 59 bp, Homo sapiens
  chr2:176944346-176944405
  hyper
gaaaaacagcagcagcgagaaacctccggggcgactcctcccccgcccccaagcaccag

SEQ ID NO: 241 - DNA, 391 bp, Homo sapiens
  chr2:176944456-176944847
  hyper
cgccgttcagccaagcaacccggacctgagagtgcacagccaggactagcttagggggcgaggggttggtctttgggaaaccaagcgctcaggacagaggtggaaagtgggtcccgggagccagaaaagagagagaagggcagacggctgggtggcaaatacaaaaatagaaataatttagggggatgcccgccaggcttttgcgcctgctccttctcccccaattcggagcaggttcccttcggcctcccgcgccccggggcgccccctggcggcagcggcagcagcgggcaacgcgcggagggctcagggggcgcacaggggactcccgggcacactcagagaggcgggcgcggccccctggcggtggcgacgtagttatctggtgagc

SEQ ID NO: 242 - DNA, 132 bp, Homo sapiens
  chr2:176945137-176945269
  hyper
ggccgccgccgccgaggaggccgcagccgctgcggctgccgcggctgccgcggcagaggccgcgctgttgagccccgcggcggccgcgggagcctggtagagaccagggtggcggaagctacacagcagctc

SEQ ID NO: 243 - DNA, 203 bp, Homo sapiens
  chr2:176945581-176945784
  hyper
cgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctct

SEQ ID NO: 244 - DNA, 68 bp, Homo sapiens
  chr2:176957347-176957415
  hyper
cccggcgggggccctcggggcgggaggcggccccccgaccggcccaggccccctcccaacctgaactt

SEQ ID NO: 245 - DNA, 53 bp, Homo sapiens
  chr2:176957576-176957629
  hyper
cgcggggccagggccagggccggggccgggccaggccgggccatgagccgcgc

SEQ ID NO: 246 - DNA, 207 bp, Homo sapiens
  chr2:176957914-176958121
  hyper
ggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacat

SEQ ID NO: 247 - DNA, 298 bp, Homo sapiens
  chr2:176959213-176959511
  hyper
tggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 248 - DNA, 168 bp, Homo sapiens
  chr2:176980770-176980938
  hyper
cctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggc

SEQ ID NO: 249 - DNA, 130 bp, Homo sapiens
  chr2:176981376-176981506
  hyper
ggccggccggccaggctctggagcacgtgacccgagaggaggctgcggctcaaggccattttcaaatctcattggcttggttgtcatgtggtcggcagaggcatccacaattacacggggaatgttttcc

SEQ ID NO: 250 - DNA, 57 bp, Homo sapiens
  chr2:177001206-177001263
  hyper
tttatgacctatttgcggtcgtcattggctgcggctggtcatgtgcaggcgccgctc

SEQ ID NO: 251 - DNA, 432 bp, Homo sapiens
  chr2:177001264-177001696
  hyper
ccttcacggcctttttcctgatttccccggcgaatttccccccgcattctgctttcccagagcctcaccccctctttttctaacctttgtctctgcagaggtgggctccagtcaccggctgcgggattgcggagtccgccgcggcctcggctcccgcccggcgcccggcctggccccaccgccgctcactcggtccgcatcgccgccacctccggagctggtggggagcccggcgagggagggcctggaaggggccctgggcgccgagtcccccgccggcgccgacaccgcctgccaggagcagccggcctgctcgaggtgactgcagccgcgcggttctggcgcggcttcttcaccaacatgagcgggtctctgcgtccgagagtgagcgcagccgggcagcgcctagtggattacagcagacgcccggac

SEQ ID NO: 252 - DNA, 75 bp, Homo sapiens
  chr2:177001781-177001856
  hyper
cgacccccttgggcagctcagtccggctgctcccctacatttcccggggaagtggggggtcgctgtctaagcccc

SEQ ID NO: 253 - DNA, 19 bp, Homo sapiens
  chr2:177053935-177053954
  hyper
cctcggccgtcttctcggg

SEQ ID NO: 254 - DNA, 364 bp, Homo sapiens
  chr2:177053999-177054363
  hyper
cggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccag

SEQ ID NO: 255 - DNA, 158 bp, Homo sapiens
  chr2:182321397-182321555
  hyper
ccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaa

SEQ ID NO: 256 - DNA, 27 bp, Homo sapiens
  chr2:182321811-182321838
  hyper
ctggcatttgggccacgccgggctggg

SEQ ID NO: 257 - DNA, 154 bp, Homo sapiens
  chr2:182322038-182322192
  hyper
cgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggc

SEQ ID NO: 258 - DNA, 631 bp, Homo sapiens
  chr2:182322399-182323030
  hyper
cgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcga

SEQ ID NO: 259 - DNA, 495 bp, Homo sapiens
  chr2:182547437-182547932
  hyper
cgtgcctaggctctcatttttccaactttggggagttccggaggagaactggggacggagtgggagaaaggactccagctagcttcgaggtcaggggtagcctagaggtccctctgctaaatccttgtcctcacccccagaaagcagaaacctccagttcgcgacatcctgtgcaatacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcat

SEQ ID NO: 260 - DNA, 100 bp, Homo sapiens
  chr2:182548061-182548161
  hyper
cgagagaagagagtcagccggatcccggagaggacagagctgaaggcgcggcggggcttagcactgaggaccttctccgcggccccgctcctcctcctta

SEQ ID NO: 261 - DNA, 29 bp, Homo sapiens
  chr2:200327423-200327452
  hyper
ggaggtagagactgtggaggtcctcctcc

SEQ ID NO: 262 - DNA, 394 bp, Homo sapiens
  chr2:219736151-219736545
  hyper
caggccccagctgaccgccccagcccgcgctgattgcacctgtctgcattcacagacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggtgc

SEQ ID NO: 263 - DNA, 102 bp, Homo sapiens
  chr2:220299533-220299635
  hyper
aatcgccggccgccccggtgaccttctgggtagcacaggccgaaggcgggcgggcagcaggaaggcaggccgccggccccccagacttgtctcctagggcac

SEQ ID NO: 264 - DNA, 174 bp, Homo sapiens
  chr2:220299885-220300059
  hyper
cgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgag

SEQ ID NO: 265 - DNA, 618 bp, Homo sapiens
  chr2:220349101-220349719
  hyper
aagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttgg

SEQ ID NO: 266 - DNA, 749 bp, Homo sapiens
  chr2:223158730-223159479
  hyper
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcc

SEQ ID NO: 267 - DNA, 145 bp, Homo sapiens
  chr2:223161540-223161685
  hyper
acgtacacacacacacgcgcgcctttacgcaccttcacaaacctcagaaataactcattggagagccccagatgtcagccgttaccccccgcccggtcttccccaacacaggggaccacagtctgggagccaggagggcaaggcc

SEQ ID NO: 268 - DNA, 220 bp, Homo sapiens
  chr2:223161806-223162026
  hyper
cgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcc

SEQ ID NO: 269 - DNA, 32 bp, Homo sapiens
  chr2:223162859-223162891
  hyper
tttcacaagtgtgggcgcagccgggacaattt

SEQ ID NO: 270 - DNA, 297 bp, Homo sapiens
  chr2:223162928-223163225
  hyper
cggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagtaggtcctcgcccccgactggtgcttcttggggtgtggggtgcccagggaatgggcttcctggaagcaccaaaggagcctgcggagcctggggatggggtgaggcagccggtcccaggccctgggatccagg

SEQ ID NO: 271 - DNA, 337 bp, Homo sapiens
  chr2:223163472-223163809
  hyper
cggggaggggggctgtcggttcctagtccagaggccggagctggaacccgggaaaggggaggacggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtcaggagccctgagctgcgattggccgacgggtagaccgtccc

SEQ ID NO: 272 - DNA, 193 bp, Homo sapiens
  chr2:223163810-223164003
  hyper
ggtggcggagacacgcgctgattgggcaacagcgaccactttctcttcccatctctggtggtgccgaggcctctgctggccccgagggggacccgcgctgcgccccttgcccaggagagaaggttggcccggtggaaactgagagagacagccccagggagatggcagttgctgagggcggagaagttcctgt

SEQ ID NO: 273 - DNA, 416 bp, Homo sapiens
  chr2:223176096-223176512
  hyper
gaattctaagcttctcgccttcctgttacagccgatctgctctgcatttggaatgcggcgtctttgcgggcgttctgagtcattcctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctttgcatctttggaagccgagggggaaataggagactttcgacggggagcaggttttc

SEQ ID NO: 274 - DNA, 307 bp, Homo sapiens
  chr2:223176719-223177026
  hyper
cgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaag

SEQ ID NO: 275 - DNA, 277 bp, Homo sapiens
  chr2:233350263-233350540
  hyper
gccagctccagacctcgcggagacgtcaacccagcccgccggcgcgcctctccctcctggccctcactgcctgccagagggctgggaaattgcggctcccgcggctcctctaaacaccgcaattaccccagggaaattacttgcgccctcctcccgcgctctgcctctgtgcgctcccctcccctcccctctcctgctcgtctcttccctcctctcctctcacgcacccgcctcccgcgcgcagggacccctgggcaaggccactgcgccccggatc

SEQ ID NO: 276 - DNA, 436 bp, Homo sapiens
  chr2:233350843-233351279
  hyper
cgccaggcccacccccgggccgcgccagcaggcgccgtaggcgctcctcgttttgctcgccgatggccgcgatggtgccataggtgagcttgtcgtcggggatggcgtggcgccgcagccaaccgccgcaggcgaacgagtagaagtcctggcatgggtcgatgctggcgtccaggttggcggccaggaagcgagcggcgcgcgcgaaggccttgcgctcagggcagccctcgggacaggcgccgccgccggccgcgaccgggcccaggtacttgagggccagcatagccgccagaatggcgcagaggccggcggcgaacaccagccccgacagcaggcacacctcgcgccggttccagcgcggcagcccggaccgggccccggtggcgctgcgcgcagcgcccaacgggaagcccgggggcagggaggccccgcg

SEQ ID NO: 277 - DNA, 181 bp, Homo sapiens
  chr2:233351415-233351596
  hyper
cgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggact

SEQ ID NO: 278 - DNA, 351 bp, Homo sapiens
  chr2:233352101-233352452
  hyper
cgagacgggttccctccccccactcccaccatctctgtccccgccccgagccactcctggcttcaacaggttctccccagaacccaaacttgggcgaagtttcacccccggcggggagcgagctggctggcgacccccgagccccggcgccgtgcggcgcagtccgcggagcccgagagccgagcccgggagccgcagccgcagccgcagccggagccgcagccgagaggacgcagacaaagccgggaggctccgcgcagtggcggcggcggcgacggaagtggccgcggtggtggcctcagcggcagggactcgggcgccacttacccggcaggtgcgcgcccgagccgg

SEQ ID NO: 279 - DNA, 257 bp, Homo sapiens
  chr2:233352506-233352763
  hyper
cgggcgtccggtgtctcccagcgcccgccgcctcctctgccgccgcgccgagcccgccgcgccgcccgcctgccggcccgagggagggggcgcgccggcggctccaccctcctccgcccgccccgcgcgcccctccttcctcctgcatctctcgggccacctggcagtggggcggcagcgcggacgtgggtcggcggccgcggagacaggctcccgggggtcgtgcgcgggctgcggtcggggactccgggtccagc

SEQ ID NO: 280 - DNA, 136 bp, Homo sapiens
  chr2:233352775-233352911
  hyper
cgagtgagggcagcgagtactcccgtgaagggtcccctccgatccagtgtccccactcccagccgcccaccagccggctggaaaggggctggagctggagatgaggagccgaggactcctccgaagggctgggggc

SEQ ID NO: 281 - DNA, 357 bp, Homo sapiens
  chr2:237072641-237072998
  hyper
cgaaaaccaagtctgggccattttccgccaccggaactgttgggaacgcggcgggaaagggtgactcggtcgctcccagccttcaccctgcgcctgaagtttgggtggaggtcttggtccccaggcccctccgccgtggggaggtgacggcctgtaagtagtaaaaattaagtcaatattagtactaacccatggcgggccgcgcttccccttcttcggctgagaacctcgccgagggccgagcgccgctgcatcgcagcggctcaccggcctcccctccttcccccactcgaaaggctgaggctggcgaagccccggcttctctcgcgcttcgggctgctggcttggtggcaccac

SEQ ID NO: 282 - DNA, 16 bp, Homo sapiens
  chr2:237072999-237073015
  hyper
ctcacactcgctggcc

SEQ ID NO: 283 - DNA, 440 bp, Homo sapiens
  chr2:237073056-237073496
  hyper
cgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactgagggctgccgggaagccggctgggctcgctgggtttttgctcctgtcgccagataacgcccggagcctgatttatggaccctccactctgccggcaggcgagcaccgcttcttttcgggccggagatatttgtaaaggaaaga

SEQ ID NO: 284 - DNA, 9 bp, Homo sapiens
  chr2:237073564-237073573
  hyper
cgcttgcct

SEQ ID NO: 285 - DNA, 377 bp, Homo sapiens
  chr2:237082343-237082720
  hyper
cgtccaacacacggagaaggaagaagcagaggccagagacgatggccggcgcttagctgtgagccccatgagcttccaatgctcgccaggagaccgtgtgtctaggagaggcaggccatggaccctatgagtcttccctggaggctggaaccccccgggactcctggacaccccaaaccaagtccccagccgctgcctccacgacggccccgacccccttcagggaagtagtattttaaagaggatgcggtctgcccggagggcacgcatttaaccctttagaaaccgcgctggagggagcagaagggtgttgaatcaacagccatgcacaccaggggcacccctccaactttagcttcttccgggaccaaatgagc

SEQ ID NO: 286 - DNA, 187 bp, Homo sapiens
  chr2:241393223-241393410
  hyper
ccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgca

SEQ ID NO: 287 - DNA, 522 bp, Homo sapiens
  chr3:239347-239869
  hyper
ggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccgg

SEQ ID NO: 288 - DNA, 182 bp, Homo sapiens
  chr3:11035171-11035353
  hyper
ttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccc

SEQ ID NO: 289 - DNA, 6 bp, Homo sapiens
  chr3:11035382-11035388
  hyper
cgggca

SEQ ID NO: 290 - DNA, 194 bp, Homo sapiens
  chr3:13590447-13590641
  hyper
cgcgccgggcggcctctaggagccgggtcagcgagtctgggctctgagcgagcggcgccggcccggccccctctccggcgggcggccgagaccccgccccggaggcggaggcggagtcaggggagggggccgggggccggctggtcccgcctctcgcgcctccgccccgccccgcgcgcacacagccaggggcc

SEQ ID NO: 291 - DNA, 48 bp, Homo sapiens
  chr3:13590973-13591021
  hyper
cgggttcccccaccccaggtccgcagcttcctccgctctgggtttcac

SEQ ID NO: 292 - DNA, 606 bp, Homo sapiens
  chr3:32858353-32858959
  hyper
gcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgc

SEQ ID NO: 293 - DNA, 30 bp, Homo sapiens
  chr3:32859255-32859285
  hyper
cgctcgcccctcgcctgtcggggcttgttc

SEQ ID NO: 294 - DNA, 800 bp, Homo sapiens
  chr3:32859417-32860217
  hyper
gggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgc

SEQ ID NO: 295 - DNA, 321 bp, Homo sapiens
  chr3:44063500-44063821
  hyper
ttctcctcaatctaacggagccattaacatctattaataacgccgacagggtaagtaacggagccgcgctcctcggggtggtcaccgggctgcgtggtcctcggccggcctcctgcatccgctgcccctgtgcgctccgggccggatgcgcaagggcggcgcggggaccaagcctggctgccggccgcctactcctccccttccctaaggtaaggggtcgttttcacactcaccagagctcctgcgggctgagctcgccccctcccccgacttctttgcggggcattttctcttgctggtgtattacgtgtcatttctcac

SEQ ID NO: 296 - DNA, 409 bp, Homo sapiens
  chr3:48693292-48693701
  hyper
ggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcag

SEQ ID NO: 297 - DNA, 31 bp, Homo sapiens
  chr3:48693851-48693882
  hyper
ggccccttcaaagaccgcgcgcccagaggcc

SEQ ID NO: 298 - DNA, 272 bp, Homo sapiens
  chr3:48693883-48694155
  hyper
ggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgca

SEQ ID NO: 299 - DNA, 164 bp, Homo sapiens
  chr3:48698847-48699011
  hyper
tcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtc

SEQ ID NO: 300 - DNA, 363 bp, Homo sapiens
  chr3:48699376-48699739
  hyper
ggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatcc

SEQ ID NO: 301 - DNA, 443 bp, Homo sapiens
  chr3:62353488-62353931
  hyper
gtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctcc

SEQ ID NO: 302 - DNA, 446 bp, Homo sapiens
  chr3:62355774-62356220
  hyper
tagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcc

SEQ ID NO: 303 - DNA, 279 bp, Homo sapiens
  chr3:62356366-62356645
  hyper
cgcacgaacccgggcttcatcctttttcttttcccccttctcatttttaaagttacttctttctcgccccccaactaccaactgaagatccaaaagtgccttggaaaatccgatccaggggccaaggatcataccggtttcccccaatcttagattgttcccgggagggttattttgcctccaatatttttcatttgaaagggaagttccggatacaaaaggaacctttttctatagggcaataccctctccttttcctacatcctttccttctgtccc

SEQ ID NO: 304 - DNA, 367 bp, Homo sapiens
  chr3:62356792-62357159
  hyper
cgccttctctctccagatccctctttgccttcctgccagccagccgcgacccgagtcctgaggtgaggtgagaagagaaggcctcgcctggcacgttacctttttggtgaaagcctttgccgcaaaattcgcagacgaagggcttgtagcccgcgtggatgcggatatgcgtgttgagcgtggagctgcggttgaacgctttgccgcactggttgcatttatgtggcttttcctgaggaaaggggcgagtgcacagtaaggagaggccacctcgggaacacctggaagggacatcccccccacccccactcaaccctagagggtaagggataatctttggccatcgtatccccggtgttatcactaa

SEQ ID NO: 305 - DNA, 1051 bp, Homo sapiens
  chr3:62359440-62360491
  hyper
tatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtgg

SEQ ID NO: 306 - DNA, 31 bp, Homo sapiens
  chr3:68980916-68980947
  hyper
gggtgggggtgggggcggggggacgctgacc

SEQ ID NO: 307 - DNA, 270 bp, Homo sapiens
  chr3:68980948-68981218
  hyper
gctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacagg

SEQ ID NO: 308 - DNA, 173 bp, Homo sapiens
  chr3:121902777-121902950
  hyper
taagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaaga

SEQ ID NO: 309 - DNA, 229 bp, Homo sapiens
  chr3:121902990-121903219
  hyper
cgggctaaggagacggtgaaggaaccgggactaactggggtaggggttagaaggcagcccgcgagtgggctacgaggggagctgggctcggcagttggggaccccgagggggcaagcgggcggggagcaggagaggggcggagctccggggccggggccggggccgcagcggccgcccagagggtctgcgggggctgctgtggccggacccgaaggcgggcgccgggag

SEQ ID NO: 310 - DNA, 325 bp, Homo sapiens
  chr3:121903323-121903648
  hyper
cggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcct

SEQ ID NO: 311 - DNA, 92 bp, Homo sapiens
  chr3:129693108-129693200
  hyper
ctcttgctctactctcgcccgtctgcgttctacattggttctgcggccgtgtccctttcgtgtgtgtctgccctgtgtttctccgtcgtctc

SEQ ID NO: 312 - DNA, 195 bp, Homo sapiens
  chr3:129693304-129693499
  hyper
cgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccc

SEQ ID NO: 313 - DNA, 259 bp, Homo sapiens
  chr3:129693954-129694213
  hyper
ggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagtta

SEQ ID NO: 314 - DNA, 698 bp, Homo sapiens
  chr3:137479943-137480641
  hyper
tacgcgcaggagctgcgtgaaaggagaggcccagagccagaaaagaggaaggcgcatcctggacgctctgcgccctggagggagacgaaaggcccggagagaagcagattaggtcggtgcccttagaggcctcttccttcacttccgggaaacagcggcggttccctgacaaaatccctgttgctcgggggttcggacgccttgctaaggctggcacgcagcggaccttgagtagctgcgctgtgtactgaacgtgtgcacagcttctccaggcaaatgtgcaagcggaaagacctcatccaagcgttatctccagccctggaggagaatgaactggtagcctggggccaaacttcaggccgtggacaaagcaggaggagtatttaggcaacctctgtcctaatgcttgttctggttgtgaccgaagttgctgactctcctcaggggtcacgtctccaggacgtgctacccggtggtttagacccgtcagggaggcacagcgtgaagggacagcgcagcgcagtagaggcacctgctggagacagcaccaggccagaccccaggatcacgggaactcctgctcccgccacagctctaaagagtgttgaataaaccggtggtcaccggtactgcgtaaggggtgtgcgtggctttgcagttcgcctaggagacaagctgatgcacggcctggaaggtgc

SEQ ID NO: 315 - DNA, 145 bp, Homo sapiens
  chr3:137481170-137481315
  hyper
attccttcccaaagccgtcgggatcgcccagtagaattagaattgggtgattcctgaatctcctatccctggctggctctgaatatagcgcaccgctggtcagacctgagtaggggttgccagcgacgctcggaaaccctttcca

SEQ ID NO: 316 - DNA, 519 bp, Homo sapiens
  chr3:137488807-137489326
  hyper
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaaggg

SEQ ID NO: 317 - DNA, 15 bp, Homo sapiens
  chr3:137489684-137489699
  hyper
agagaaagacctgac

SEQ ID NO: 318 - DNA, 1135 bp, Homo sapiens
  chr3:137489875-137491010
  hyper
cggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatccc

SEQ ID NO: 319 - DNA, 161 bp, Homo sapiens
  chr3:138658703-138658864
  hyper
cgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggt

SEQ ID NO: 320 - DNA, 668 bp, Homo sapiens
  chr3:138665557-138666225
  hyper
ccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtgg

SEQ ID NO: 321 - DNA, 105 bp, Homo sapiens
  chr3:138679188-138679293
  hyper
agtagcatgaagaggcgggaaattcaggatgggagagggctgcaggacaaagactgcgggcagtccggccgggttcctgggtggaggaaggaaggcacgtttccc

SEQ ID NO: 322 - DNA, 82 bp, Homo sapiens
  chr3:139653491-139653573
  hyper
gctatctactctgcccgacaacccctagcaccactaggcgctgctctagtgtgcgcctggcgccctccccagaccagtcgac

SEQ ID NO: 323 - DNA, 298 bp, Homo sapiens
  chr3:139653574-139653872
  hyper
cagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagac

SEQ ID NO: 324 - DNA, 682 bp, Homo sapiens
  chr3:139653873-139654555
  hyper
gctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcaga

SEQ ID NO: 325 - DNA, 674 bp, Homo sapiens
  chr3:140769628-140770302
  hyper
gtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggc

SEQ ID NO: 326 - DNA, 183 bp, Homo sapiens
  chr3:140770407-140770590
  hyper
cgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccgg

SEQ ID NO: 327 - DNA, 40 bp, Homo sapiens
  chr3:140770643-140770683
  hyper
cgcagagggggcgctgctgccgggcatcagccgtgaggac

SEQ ID NO: 328 - DNA, 356 bp, Homo sapiens
  chr3:140770684-140771040
  hyper
cgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatca

SEQ ID NO: 329 - DNA, 355 bp, Homo sapiens
  chr3:141516389-141516744
  hyper
acagttctcctgccacggcaaacaaaacatgtacattctgattccctcttctgtttggattgtgctgtcgactggatctggtttgtgatgagctgggggaagaggcatccgcgggcgatttctggctcggcgtgccagtgtgcttttgctgggccgcgccgggatcgcggagcttcctctccggctcctttctccccgtctgcgtcgctaatccagcctggcccggccaccccaagggaagacacggccgtttcttttgatagtggaattggaggttgccaagttttcagatttaatgggaggtggagggttgctcgtgtccttgaccttgaaggacctgcgcacactcatactt

SEQ ID NO: 330 - DNA, 229 bp, Homo sapiens
  chr3:147078959-147079188
  hyper
gcctcattttctctccgttgttctcgggggaaccaaaataggggttgagattctggtctctacaagcctttcaagcgccttcaactttggcggcggcagcagcaggttgcgttgccatggatactgtactgtatggctgtggcggcggccacggcggccgcagctcgaatcccctaaacaatgccgagccaagtgcaggtttctcgcccttttccgtgcacttttctct

SEQ ID NO: 331 - DNA, 497 bp, Homo sapiens
  chr3:147110228-147110725
  hyper
cgtgtaggagaggaaaggaccccgagaacccggaagcctagattcctgccggagctgcaagtgctgcggaaatgggggaagaaggtttctgggcgctttaaacaaatggctgcctcccagcgctctgagttaagggaccggctacctagcgtctagctgaggaggaagacgcgcagctggagaactgttgcctttgtagttgcttctcccgccgcatccaggaaaaacaggcgctttggggctggttagaacaaacaaagccccaattcccgagccctgttgaggctcggacagagaggtttgcgcacaacctgcgcttctgcgcaatcagcggctcctgagcccgggtctccggcaccacctggtcgctggattcccaccctacaggagcacagctagtacactgaacagtctggaaggtgttggcacctgccatttcgcgggacactggcaccattttataaaacagtgatagaaagatgcggaataaatcagtg

SEQ ID NO: 332 - DNA, 236 bp, Homo sapiens
  chr3:156009064-156009300
  hyper
cttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggac

SEQ ID NO: 333 - DNA, 265 bp, Homo sapiens
  chr3:156009318-156009583
  hyper
cgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaa

SEQ ID NO: 334 - DNA, 858 bp, Homo sapiens
  chr3:179168782-179169640
  hyper
cctggaaggaggcctcggggagtgacgagaaaccaggggggtctgcaggacttggaccgccgaccgttcctcgctccccggggcgagcggtctggaccgcccgggaagtgcctgcgccggcggtcgtggggccagttcccgcgtggcagctgggcgcgacacaggcgcgccctcctcgtccctcccgggcagcgtcggccgcccgagcccggggagacccgccccgccccgcgccgtcacccgggccccgttccgcaggggtggctcgcggcgccccacgtccctgcgagaagcccgggatcgcttcgcggggcgcaccgacgagccgccgctcgcgagctcgccgcctacctggagggagctcaggcccgcgtcgaccgcgcgctgccggtgtccgctgggcgctcagcagcccctggagcgcggagccggcgtggagagcgcagctcacagccgagaccagagccgccggccacacccagtcccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 335 - DNA, 255 bp, Homo sapiens
  chr3:179754505-179754760
  hyper
agccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctg

SEQ ID NO: 336 - DNA, 70 bp, Homo sapiens
  chr3:179754803-179754873
  hyper
cgccgccgcagctgccgagcggggcgcgcgccgttctcccagccgcgtgcctgccgagaggccgcgggac

SEQ ID NO: 337 - DNA, 286 bp, Homo sapiens
  chr3:179755086-179755372
  hyper
ggccggaagaaaggcgggaagacatgcatcgtctctccgggggccatccaccgcggctgagcctgttatcctacagacattataggctgagtgcaggggttgccgaagagtttacttcggttctgattcagctctcgaaagttacgtccgtatcacccgttaaataaagactccccgctcccctcatccccagttcatcgccgagcattctatttaaaacggcaaaccctagtccctgaggatctggcatgttttatttttttccctagcacgtaacatcacctaa

SEQ ID NO: 338 - DNA, 743 bp, Homo sapiens
  chr3:181421539-181422282
  hyper
tgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccactt

SEQ ID NO: 339 - DNA, 729 bp, Homo sapiens
  chr3:181441019-181441748
  hyper
tcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaaccta

SEQ ID NO: 340 - DNA, 448 bp, Homo sapiens
  chr3:181441962-181442410
  hyper
ggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttc

SEQ ID NO: 341 - DNA, 130 bp, Homo sapiens
  chr3:187387791-187387921
  hyper
ttttctcaagagcttcgggagctgagggacccagaaaagcaccaaaactctttagaaggactgagcatcccttacgtccaaaccaatggggcaggagcaaggcttagggagggctggagaatccgggaga

SEQ ID NO: 342 - DNA, 183 bp, Homo sapiens
  chr3:187388006-187388189
  hyper
cgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctct

SEQ ID NO: 343 - DNA, 406 bp, Homo sapiens
  chr3:192126305-192126711
  hyper
acttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggc

SEQ ID NO: 344 - DNA, 63 bp, Homo sapiens
  chr3:192126786-192126849
  hyper
cgggggcagctgtttccagctgcggtgagagcaactcccggccagcagcactgcaaagagagc

SEQ ID NO: 345 - DNA, 110 bp, Homo sapiens
  chr3:192126850-192126960
  hyper
ggaggcgagggaggggggagggcgcgagggagggagggagatcctcgagggccaagcacccctcggggagaaaccagcgagaggcgatctgcggggtcccaagagtgggc

SEQ ID NO: 346 - DNA, 49 bp, Homo sapiens
  chr3:192126961-192127010
  hyper
ctctttctctttccgcttgctttccggcacgagacgggcacagttggtg

SEQ ID NO: 347 - DNA, 59 bp, Homo sapiens
  chr3:192127314-192127373
  hyper
atggggattacccgccggacgcaaggccgatcactcagtcccgcgccgcccatcccggc

SEQ ID NO: 348 - DNA, 175 bp, Homo sapiens
  chr3:192127556-192127731
  hyper
cgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggaggggg

SEQ ID NO: 349 - DNA, 54 bp, Homo sapiens
  chr3:192127936-192127990
  hyper
cgcccaggtggggccgagctgggggccgggcccctggagcgctgggaagcacag

SEQ ID NO: 350 - DNA, 290 bp, Homo sapiens
  chr4:8858758-8859048
  hyper
ctgatcgcgacactgcactccagcctgggcgacacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 351 - DNA, 557 bp, Homo sapiens
  chr4:8859381-8859938
  hyper
cggatcgttccgccgttcgccctgggtctgagtctgggggttcgggaaacaattttggacgtttctggttggattgtgtctaaatcgtgcattttacgcgacaggggactcgaggtccttgaggatcccaaactgccgcagcccctccctcctcctccccttgcccttgcccctgcccagagaagtgcgctcctccagggtcatccacacgcgccgtgccgagccccgggccccagttccaggagccgcgtctctacgggccagtgggtcctgagagagtagggcttcgggcgctcggggagaggaggcggaggaggggtgaagccgaggggtggcttttaacgaaaaagaagttgaagcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctga

SEQ ID NO: 352 - DNA, 156 bp, Homo sapiens
  chr4:8869115-8869271
  hyper
gctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcc

SEQ ID NO: 353 - DNA, 445 bp, Homo sapiens
  chr4:8869368-8869813
  hyper
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattcca

SEQ ID NO: 354 - DNA, 273 bp, Homo sapiens
  chr4:10462775-10463048
  hyper
tgccagtctctgagacgttttctcaactgcaaaacaggagtaactggagcaacctttcgtggagggtgccaggcgctggagcgtggctaaggcagggaccacgtcccagccgccctttcccgccctgcggcgcaggcccactctcttggctctcctggcccgcacactcagctcggccgccgcggctgccgcggaagcgcgcagtgaggctagtggggccacgagcggcgcgctgagcatgcgcgcccgatagagcctcgagatgcgccgggc

SEQ ID NO: 355 - DNA, 184 bp, Homo sapiens
  chr4:10463072-10463256
  hyper
cggcctgcagtgtcgctgcgagcccggctggcccagctcggcgtgtagagctctaccccgcgcggcgggcggtgcagccccgcgctcacctgggcgtcttcgctcccgctcgccccgcgcttccgaaaatcgggaatgtaatgttttgtttttacattccaatttgctccctccccaggctggc

SEQ ID NO: 356 - DNA, 280 bp, Homo sapiens
  chr4:10463257-10463537
  hyper
tggaatccgagggttcctgatgactgcagctcctcgcccctcccgctgtgttcccgccgcctctgggctgaaagcgccatcaggacccgtggcgcgtgggctttgttaagtcattaactgcttgggacatagcaggagcatggtgcgcggcacagaacaggcttggcttccacggcccatccaggcggagccgtcagcgtcccttgcctagaccagagctctggaaagcggagaggcggacaggggccgttccccagatctgttccggaggatgcagatc

SEQ ID NO: 357 - DNA, 83 bp, Homo sapiens
  chr4:13545940-13546023
  hyper
cgcccctctggcgcggccagcccgccgcgctcctctttcttgttgaggatcgcctggatggagaaggacgtcaaggtgttggc

SEQ ID NO: 358 - DNA, 35 bp, Homo sapiens
  chr4:13548555-13548590
  hyper
gtgagaaaggggctacgttccgcgtcttccggagg

SEQ ID NO: 359 - DNA, 328 bp, Homo sapiens
  chr4:13548634-13548962
  hyper
cgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggc

SEQ ID NO: 360 - DNA, 73 bp, Homo sapiens
  chr4:41258716-41258789
  hyper
cccaccaacaaatcccgtctccacaaccaccagattatctcaccggcgagtgagactgcaaggtttgggggcc

SEQ ID NO: 361 - DNA, 381 bp, Homo sapiens
  chr4:41259085-41259466
  hyper
cgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgt

SEQ ID NO: 362 - DNA, 333 bp, Homo sapiens
  chr4:41750266-41750599
  hyper
tgtgtaagcaaatttcgtttggtaaatactaaacacatttccattttcaaatgcaatcaaggcttcctatatacgggcggaaaggcggcttcctccgctgagaaagctgaaggtccttacctgcggcgtacggactgctctggtggtccctgagggtgcccaggctgcaggatcccggcgtgagggaagggcagccggacgtggccccaaaagtggtccttatcgggttatactggaagccactggcctggctgcaggaactgaagtcagcataggctgaagccaggctcgaggtgtccatcccagccatacaggactcgtaggcagaggaat

SEQ ID NO: 363 - DNA, 341 bp, Homo sapiens
  chr4:41875410-41875751
  hyper
aaccttttttgtaaccggctgaatggctgtatctacggagccagtaggttgcggaaaggcgttcgcagggtggaggagcgggtagttggggaaccgggcgcgcctgatggggcgcaggaaggaaaaactgatcgacgcaatggcccccgccaccggccatttggggctttcaaacgccctaacgaggagtccgagcggccactgaaagcctccctgttcctgggcagggcagccagagtgccctcccctctcccttcccagcctcccggcggcgccaccattaacccggagccagacccaggcggaggccccggcgccgaggcccgcggaagcaagagaca

SEQ ID NO: 364 - DNA, 689 bp, Homo sapiens
  chr4:41882935-41883624
  hyper
gggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccg

SEQ ID NO: 365 - DNA, 451 bp, Homo sapiens
  chr4:42152961-42153412
  hyper
cgactcccggggcaggaaggaggggcgggatggttccccgcgcccgaaatccacggcgtggcggacgcggaggagccccgagtctcacaaccaaggggtgggaaggaaaagggacagagcgagacagagcgcccccgagaaacacaggcgcacaaaaaaagacagaaggaaaaacggaactgagagccagccagcatggactgcgacagcgtgagagtgcatcaaagaggtggcgaagaaagcactagaaggcaaaggagaagtggagagaagaagaaacaaatggaggaagaaggagaaagggaaaaagcagacggaaaaagtgaagtagtacgagggcgtcccagcggggcggcccgagaagctccagcttcttcccgagcggccgccgctatcccccgggggggcgtctggccccactccggaccacgcccgagcgatcctggtcgcc

SEQ ID NO: 366 - DNA, 101 bp, Homo sapiens
  chr4:42153532-42153633
  hyper
cggggaggccccaggtgcgccccgacatcccgacacggcccagcacgggtaagtgtcggcggccccccgcttctccttcctgggtcccctcccgctgcccc

SEQ ID NO: 367 - DNA, 504 bp, Homo sapiens
  chr4:42153881-42154385
  hyper
ggcccggccgggcccgggggggtaggagctctgcgcctggaactgctgcggcggcggctcgctgctgctgatggagacggcggcgtgcggcgcgaagggcggcgggggcggcgggggcgcccgcacgtgcggcagctccaccagggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtgtgtctgtgccgtggccgccgccgccgccgcctgtcgctgaggctggcatcgccgagcccccgcgcggggggctgccgcccgagctcctgattgacaggctgcctc

SEQ ID NO: 368 - DNA, 611 bp, Homo sapiens
  chr4:42154386-42154997
  hyper
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccat

SEQ ID NO: 369 - DNA, 130 bp, Homo sapiens
  chr4:54975802-54975932
  hyper
tgtccttttctaggtcgggggtggggaggggcggtgggtggacgcagagggaggaaggctcagccttggatccttgccacctgaacaacgtcgcctctgcccacgtggaaagcctcgcttgtctggcagc

SEQ ID NO: 370 - DNA, 126 bp, Homo sapiens
  chr4:54975990-54976116
  hyper
cgggcaccagcgtccgggcgggaagggacgtgtgcccaagcctcgcctcctggccctcagtgggctgggacgcccttgatcaccggcgcaggaaagaggctccccagcccgtgagcttcgtccggg

SEQ ID NO: 371 - DNA, 1 bp, Homo sapiens
  chr4:57521395-57521396
  hyper
t

SEQ ID NO: 372 - DNA, 159 bp, Homo sapiens
  chr4:57521505-57521664
  hyper
cgccctccctcccggcctcagcctcctggttcgccaaaccggaggactgaatttatggctagctggtctctggggcgccttccagctctgacattcccgcctagaatagatcttcccgaaggtttcgcagacagaccagaggggaccgagccgggaagg

SEQ ID NO: 373 - DNA, 683 bp, Homo sapiens
  chr4:57521700-57522383
  hyper
cgcagagggagaaagcgtgtatcccgggctgccggggagagtggaaaagaaaggactggtgaccgaggggtttctgcgcagctcccggggaaccacggctggatgggggtggcggggagaccgggcgcccatgggagcggggaagcggggaggcggcggcgggagccatgcagggtctgggcccctgggatgcgggcagaagcgatgggagatcatggggagggcagcccggcgggaggcgcggacgaacaggaccgcccagccgcgagaaggctcagcccaggcaggggtcggggcgcgctgggcgcgtgtggggacgcacctgggtctcctcctcggaaaggcctgcctcggccgcgatgaggcacagcgtggtggaatccgggtgcttgtcgaccttgttgaagttgtactccaggatttccacctggtcctctgtggggccgctcgcggtctccgccgacatggtccctgcgcgctgcggggcagggagaagcggcggcggtgagcgaggcgtggagcgggcgggacgcagcgaaggaaggcggtcgcggcgccgccgggcagccccagccccaggccgccccctccagcggtgccacggccgcgcaagtccccggtggctgcacgctgagcgggggcttacggctgccccccacccgggcctccctccctggactgag

SEQ ID NO: 374 - DNA, 396 bp, Homo sapiens
  chr4:57522419-57522815
  hyper
cgcctcccgcgccccccgggaccccttgcaggaactgtatccctgcctgcgacgggggcgagatagatgattccgcgggccctcaccgacctccggctctaaggaaggagtgaaggaagcgcgggggtgattttgagaaatccccttaaaaacttcctcccgaaagggggacctcccctggggacagacttgacagatcgcgagggtgggttcgcccgagtccgcgactagccggcctccggcctccccggtaggcggccttctgtctccgcagtgggttggcgctttggggccctctccaggcagggctgcacaccccacccttcctccaaaaaagttccccgcaagacaagttacttctcaaagttggggagacggaggcggtgcttttaatgt

SEQ ID NO: 375 - DNA, 30 bp, Homo sapiens
  chr4:85404111-85404141
  hyper
ggggcgcgtgtcagcgttggagagcctgcc

SEQ ID NO: 376 - DNA, 252 bp, Homo sapiens
  chr4:85404224-85404476
  hyper
cgacctgcagggggcgtgcccggcatgggaagctcaggctacgtctccgaagcttgcgctgaaaacaccagaggtagggaaaacggggagagcgtactgtgctgggctctaccctggacaccccagtttcattctctgcgaagccacgcgctggcagggctctcgggacggcgatacccagggatgatggtacccctggtctcggcgggacctcccgggaacttgtcctgggggagggagcccaactggcca

SEQ ID NO: 377 - DNA, 44 bp, Homo sapiens
  chr4:85404649-85404693
  hyper
cgttcggccgggctcagtaaagaatttgccgaaaggtagaaact

SEQ ID NO: 378 - DNA, 123 bp, Homo sapiens
  chr4:85419120-85419243
  hyper
cggggggctgccgagggatgagagcccccccgtggccgggggcttcaggccgcctgggttgtgggtgcccagaggcggggagggcgacgaggaggacgacgacgaggacgaggaggagggggg

SEQ ID NO: 379 - DNA, 365 bp, Homo sapiens
  chr4:107955250-107955615
  hyper
ctgcaaaattgtccccgtgagagggcagtagggggccaagcccgggtcttgtctctctgtccatcccagaatggctcggccctctcaaccaaccttcagccggctggctgcgctgtggacaggggcggcggaggacaccgagagcgcgcaaaacagcagcatcagtcggttccaaggaaactcggatctctggggcgtgggccgctgccaggggttgacacttgtgttgtgcgaggtgcgtgtgccattggtaaaatggctttctcagttttggcttcccacaaaaggagcggaagggggagctgtcatgattcccagtgcccacagagccccctctcctggccacagcgcgccagccacaactg

SEQ ID NO: 380 - DNA, 239 bp, Homo sapiens
  chr4:113441947-113442186
  hyper
gagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcc

SEQ ID NO: 381 - DNA, 237 bp, Homo sapiens
  chr4:113442246-113442483
  hyper
cgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatcc

SEQ ID NO: 382 - DNA, 275 bp, Homo sapiens
  chr4:113444020-113444295
  hyper
tatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataac

SEQ ID NO: 383 - DNA, 133 bp, Homo sapiens
  chr4:113444296-113444429
  hyper
cagttgctagtacagctctcggcggaggagccagggccgggtctccaggccgggagggggcggccgcggtgcgcccgggcagcgctccctgcgcaagtagttcttctatgtctttacacgcacttccaaaaaa

SEQ ID NO: 384 - DNA, 251 bp, Homo sapiens
  chr4:122301462-122301713
  hyper
cccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagc

SEQ ID NO: 385 - DNA, 48 bp, Homo sapiens
  chr4:122301962-122302010
  hyper
cgggaaaggagagcagctcagggatcaaacccacgataaagaggcggg

SEQ ID NO: 386 - DNA, 244 bp, Homo sapiens
  chr4:122686209-122686453
  hyper
caggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatcc

SEQ ID NO: 387 - DNA, 16 bp, Homo sapiens
  chr4:122686454-122686470
  hyper
gcgcagactctcccag

SEQ ID NO: 388 - DNA, 761 bp, Homo sapiens
  chr4:134071850-134072611
  hyper
gagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccgggg

SEQ ID NO: 389 - DNA, 304 bp, Homo sapiens
  chr4:134072676-134072980
  hyper
cgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacat

SEQ ID NO: 390 - DNA, 565 bp, Homo sapiens
  chr4:140200592-140201157
  hyper
caaaggaaagtgtcccgaaggccgcttcctttttgggggttgtggatctcagagccaggcgctcgcggggttcaggctgctgagaccctgccaagggttaggtttatttaccccacgaacattcgcccagcgtccactgagcgggccctgcctcactgcctcccagcgcttgccgggcccgctcgctgatcggcgtccaccttcccaccgttcctctgcttcctcaggagattggagagcgaatggtgcctctaacaataaaagtggtaagctgcgactttgtcagccaggcacgtttttaagtgcttttaaccatacattaactcattaaaaaggaaaaccatcatcgccctcattttatagatgaggaaacaggttaagccatttgtccaagatcaggatgcgaacccagataatctggactctgaggcaccctggaaaagttccctacttccaaagtctgcaggagcttcgggacgtcttcccgggagtctcccccagtctcctcgacctccaatccaggcttctgctgctctgggtcgggtttggccaactgggtgccggc

SEQ ID NO: 391 - DNA, 270 bp, Homo sapiens
  chr4:140201192-140201462
  hyper
cgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggaga

SEQ ID NO: 392 - DNA, 510 bp, Homo sapiens
  chr4:141418921-141419431
  hyper
agacagccatagtttcgagaaggaagaacaggagaggggaaaagcagtgcacagacggggtccttgaacctttgaggaaaagggagcggcgggtaccctgggccagatgcgttagcgcgcgtgcaggccggacgcggccctggaggaggaggtcggggcgcgggttacagcccagccgccgctgaccggggtaggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccaggg

SEQ ID NO: 393 - DNA, 104 bp, Homo sapiens
  chr4:144621336-144621440
  hyper
gaagaccaagtccaccgccagcgtgaagggcagcaccagagtgtgagtcggggcgtcgtagcgcagctgcagcagcacccgggcgcgtccggggctgtgggagc

SEQ ID NO: 394 - DNA, 383 bp, Homo sapiens
  chr4:144621514-144621897
  hyper
cgcggcagggcgtccagtaccgtgacttcgcaccggtcccccggctgcactccaatcaccagatcccggagcgggtcgagccaaagggaacgacccaggggcacccggagtccagggttggcaatcagcacgctggggccgtcggggcgagtgccgtcaagcgcaccccgggcgggcaggtaaagcgccgggtcgggctcggtcccaagtgaggatgcccgtccctgcagcgcggggcgactcaagagcaggcaggcgagcgccacaaggagctgccggggcgtcccagtcgggtgccgagaagcccccgccatggccacggatggctcctggcgttgggattcccggggtggggtgccctgtgcaaagagggatctgctgag

SEQ ID NO: 395 - DNA, 173 bp, Homo sapiens
  chr4:144621981-144622154
  hyper
cggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcct

SEQ ID NO: 396 - DNA, 889 bp, Homo sapiens
  chr4:147559190-147560079
  hyper
gggagggggaggagtcgcatgcgcacagacgacccgagcctgctccgcggctgtccaatccgctgagagctgcgagaaatcgagtgagagaaagccctgcagcccctccgaccccatgtctctttggcaccaggcacccgccgggccgtggggggctcgtagccgaacgccgacctccgctcgtattgggctgggagttcagagccgcgcgcagaacccgggttggccgcaacgtctgtgttctcagcggtggccgggaacctgggatcagggtcacctgagctgacggggtgggggcgggccgagtggggttggaagcctggaacttagtggtaagcaggaggcgtaggaggtggcagccaggtaagaggcactcttacctacccaacgctggcttgggccgcaactttatttgggagtttctttttccggtgagacagagacccggcagaagaagcgggaggggctggaggctggtccttaggtaggcactgcccggcgactggagcgcggacctggccatttgggtggggttgagtgggggcgcgattgtgagtagcagccgcgggacgctgcgaaggggcggcggcaacagagcacgggcgggggcagaaaagaggcggcggagggcgcggtgggggagcgcgaggcgagtgctgagagagcagaaaggactcaagcctgaggggagtagagaggaagaaggggcaacgcgagaaaccgaacaggagccggcgtttcctggcaagggagggcggaggcgcgcgggagagagggagagagggagggcggggggcgcgggggtaggcgcggggagaggggagtataactcgccggccgcgaggagcgggggcagtttcgggtgccgaggtctgcagctagcggcaag

SEQ ID NO: 397 - DNA, 286 bp, Homo sapiens
  chr4:147560133-147560419
  hyper
cgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccct

SEQ ID NO: 398 - DNA, 52 bp, Homo sapiens
  chr4:147560459-147560511
  hyper
cggcggcggcggcggcggcggcggcggcggcggaggccgaagcagcagctcc

SEQ ID NO: 399 - DNA, 135 bp, Homo sapiens
  chr4:154709476-154709611
  hyper
aaggcttaccttcctcggtggctggcaggaggtggtcgctgctagcgagggggatgcaaaggtcgttgtcctgggggaaacggtcgcactcaagcatgtcgggccaggggaagccgaaggcggacatgaccgggg

SEQ ID NO: 400 - DNA, 70 bp, Homo sapiens
  chr4:154709758-154709828
  hyper
cggcctgctccagcacctccttcatggtctcgtggcccagcaggttgggcagccgcatgttctggtattc

SEQ ID NO: 401 - DNA, 675 bp, Homo sapiens
  chr4:154709829-154710504
  hyper
atgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcggg

SEQ ID NO: 402 - DNA, 149 bp, Homo sapiens
  chr4:155663475-155663624
  hyper
atgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatg

SEQ ID NO: 403 - DNA, 88 bp, Homo sapiens
  chr4:172734188-172734276
  hyper
cgcctccacctcccgcagccgccgcgccccggctcgccgcgctcccgccggcaccatggaggaattcctgggacaaccgcctgcagcc

SEQ ID NO: 404 - DNA, 115 bp, Homo sapiens
  chr4:172734277-172734392
  hyper
gcgacttttccccaggaatctctggcctggcgccctttgggtgagatgacggggtgctggcatccctgtcggtcccagattacccggaaaagccctggcaggtaaagagaggacc

SEQ ID NO: 405 - DNA, 14 bp, Homo sapiens
  chr4:172734591-172734605
  hyper
ggggagtggggcgc

SEQ ID NO: 406 - DNA, 244 bp, Homo sapiens
  chr4:174430310-174430554
  hyper
actcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccc

SEQ ID NO: 407 - DNA, 279 bp, Homo sapiens
  chr4:174430793-174431072
  hyper
ggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttct

SEQ ID NO: 408 - DNA, 243 bp, Homo sapiens
  chr4:174451855-174452098
  hyper
gggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctg

SEQ ID NO: 409 - DNA, 836 bp, Homo sapiens
  chr5:1294607-1295443
  hyper
cagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 410 - DNA, 75 bp, Homo sapiens
  chr5:1295604-1295679
  hyper
cgctggcctgatccggagacccagggctgcctccaggtccggacgcggggcgtcgggctccgggcaccacgaatg

SEQ ID NO: 411 - DNA, 517 bp, Homo sapiens
  chr5:1875025-1875542
  hyper
gagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatt

SEQ ID NO: 412 - DNA, 478 bp, Homo sapiens
  chr5:1875829-1876307
  hyper
ggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 413 - DNA, 223 bp, Homo sapiens
  chr5:1876637-1876860
  hyper
cgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggg

SEQ ID NO: 414 - DNA, 187 bp, Homo sapiens
  chr5:1883430-1883617
  hyper
cagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactg

SEQ ID NO: 415 - DNA, 347 bp, Homo sapiens
  chr5:1883879-1884226
  hyper
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggc

SEQ ID NO: 416 - DNA, 174 bp, Homo sapiens
  chr5:1884557-1884731
  hyper
atataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaa

SEQ ID NO: 417 - DNA, 67 bp, Homo sapiens
  chr5:1885314-1885381
  hyper
ccttccttccagacccggcggggcttaactggagccgaagccccagaacaggcggccattcatcttc

SEQ ID NO: 418 - DNA, 103 bp, Homo sapiens
  chr5:1886739-1886842
  hyper
cttgctccctgggtacggcctgaggctggacggagcgccgtccgggcgtccaggactcaggcctggccactccgagccccccaccccccgccccgcgccggcc

SEQ ID NO: 419 - DNA, 149 bp, Homo sapiens
  chr5:1886997-1887146
  hyper
cgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccgggg

SEQ ID NO: 420 - DNA, 36 bp, Homo sapiens
  chr5:1887546-1887582
  hyper
gggaggtcacacagccctaacaggacagtgggaagg

SEQ ID NO: 421 - DNA, 101 bp, Homo sapiens
  chr5:1887655-1887756
  hyper
cgtttgggctgccccacccagggacgcttgggccgggcgcgaagagcccggaaatagccacccttgtcgtcggcccggtttccctccgaggtcttagtatt

SEQ ID NO: 422 - DNA, 31 bp, Homo sapiens
  chr5:1930974-1931005
  hyper
ctcctgggattaggccggaggaatcttggat

SEQ ID NO: 423 - DNA, 223 bp, Homo sapiens
  chr5:1931064-1931287
  hyper
cgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgc

SEQ ID NO: 424 - DNA, 133 bp, Homo sapiens
  chr5:1931444-1931577
  hyper
cggtggttctgtggctgtgagggccgtttctgtccgtccacaccgccttccctctgcaggtgaggaatggggtctgcttcgtttggaatgtgcctttgccgggtcctgcctgacctccaccttccagccggga

SEQ ID NO: 425 - DNA, 349 bp, Homo sapiens
  chr5:1931617-1931966
  hyper
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgt

SEQ ID NO: 426 - DNA, 253 bp, Homo sapiens
  chr5:3590405-3590658
  hyper
ttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 427 - DNA, 844 bp, Homo sapiens
  chr5:6448738-6449582
  hyper
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccaggtaaggcgagcgcgccggggctgggggcgcggggccgagatcgggtctgcagcgccgccgggcgcccgggccccgtggtgagggccagcgccggcccctccggccatctcgctccctgctctgactacaccagcgccccacggggatgctccgagcgcctccacctcttttccctgagcgttttcttcctgcccctgctttccgtcccgtctctcccgtccc

SEQ ID NO: 428 - DNA, 31 bp, Homo sapiens
  chr5:10564628-10564659
  hyper
tgaccccaccaccgccgtccccaccccgggg

SEQ ID NO: 429 - DNA, 428 bp, Homo sapiens
  chr5:10564800-10565228
  hyper
cgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccc

SEQ ID NO: 430 - DNA, 1 bp, Homo sapiens
  chr5:10565262-10565263
  hyper
c

SEQ ID NO: 431 - DNA, 358 bp, Homo sapiens
  chr5:10565264-10565622
  hyper
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagag

SEQ ID NO: 432 - DNA, 207 bp, Homo sapiens
  chr5:42951105-42951312
  hyper
ggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 433 - DNA, 693 bp, Homo sapiens
  chr5:42951419-42952112
  hyper
cgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgc

SEQ ID NO: 434 - DNA, 457 bp, Homo sapiens
  chr5:42991785-42992242
  hyper
tggaggagccaaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttatggctgacacctccacttgtttctcagagccggggctgactgccggctgcatctttgaatggcgaccaaaaaagacatgcatttgtctggcaaagtcgctggcgttcgcctggtgcccgcgcttgccgggtcctagagcagccagattttcacaccag

SEQ ID NO: 435 - DNA, 180 bp, Homo sapiens
  chr5:42992375-42992555
  hyper
cgtcccattctccatccgaggccttctagtcccggtgtcactgtcgcagcacctggcgttcgttagctctttcaccagcggcgcggagcgggcggttttgctgtcacggcacatgtggcacggagtttctcggtggccgaaaccctcttttttctcagagtccagtttcttggtgacagc

SEQ ID NO: 436 - DNA, 42 bp, Homo sapiens
  chr5:42992556-42992598
  hyper
ctgttggttgcgccataaggaatgttgtccttgacaacccgc

SEQ ID NO: 437 - DNA, 239 bp, Homo sapiens
  chr5:42992782-42993021
  hyper
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttctt

SEQ ID NO: 438 - DNA, 240 bp, Homo sapiens
  chr5:42993321-42993561
  hyper
tgactacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccctgcctcaagtttct

SEQ ID NO: 439 - DNA, 276 bp, Homo sapiens
  chr5:42993861-42994137
  hyper
ttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagc

SEQ ID NO: 440 - DNA, 157 bp, Homo sapiens
  chr5:50263484-50263641
  hyper
cctcgccccaattaacgccctacagccagtcagccttacacctgctggaaaaatcttggtggcagtggtgggaggtggtggttttggtttttagcagagcgcgggagcaccctgtcacaccctcctgagaccgccctaggaccgtcctctggaatat

SEQ ID NO: 441 - DNA, 347 bp, Homo sapiens
  chr5:54516334-54516681
  hyper
gtggctcaggttcaacgcgctccggctgcagtctgtgcgcagcccccggaaggcgccatgcaggttcccgggcctggtgtcagtattcgcgggctctggcagcagtcggggccgcttgggatcgcggctctgaagggcttcatcgcagcgctcggaaatctccctcaggatggcgtccacttccgcgcaatcctgccccgcagcgctgaccaactcctccaggctccttttggccttcgccttgagcaggaagggctcggccgccgccccacaatcccgggactgtgtgatcatcagcttctacgaaagacagggaagagcgccgccctggggcctgccggaccctc

SEQ ID NO: 442 - DNA, 96 bp, Homo sapiens
  chr5:54516831-54516927
  hyper
cgccccacttacatccagcaccgaggccaggtgccgggttcggctggcgagttccttcagctgcacgttccgctccttgagcgaggcgatctcctc

SEQ ID NO: 443 - DNA, 156 bp, Homo sapiens
  chr5:54519133-54519289
  hyper
ggaacccagcaggcttgcactgccacggtggggagcgggacgcacggagcacgacactgactgggggaagggggcagcagttcgcggctcctgcagagcagctgcgtggcgggaatgggtccttccaccggcggtgcggcggccctgcgccggctc

SEQ ID NO: 444 - DNA, 80 bp, Homo sapiens
  chr5:63255163-63255243
  hyper
cctcaggtgtctacccgcgcttcagggcgccccagagcgtaggcggaggaacccagatcctgtaagtcagcagccgggag

SEQ ID NO: 445 - DNA, 481 bp, Homo sapiens
  chr5:72529345-72529826
  hyper
ctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 446 - DNA, 374 bp, Homo sapiens
  chr5:72529889-72530263
  hyper
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgttt

SEQ ID NO: 447 - DNA, 35 bp, Homo sapiens
  chr5:72594802-72594837
  hyper
tgtgaagcatgtgagcggggctcagtttacaggta

SEQ ID NO: 448 - DNA, 71 bp, Homo sapiens
  chr5:72594867-72594938
  hyper
cggcctcgaggatttcggggggtttgcgccgccgaggaaaccctacccggacgaggcgagcagcctggtgg

SEQ ID NO: 449 - DNA, 383 bp, Homo sapiens
  chr5:72599059-72599442
  hyper
cgaatgcagcgcccgggagtcagggctgttagtggcgtggcccgccgggcattgagctgtttcctccaacgcccggtcccccgcggcctaggcccagtgtttgcttttgcagatacgtcagagggaacattcaggaggggcgggctcccaggctcccaggagaccgcccggagcctccggagcgcgacgaggcgcggggcctcggagatctggcctgccagattgagggggaggggagggggcctggcccagcagctggacaggcgcgcagtgcccgcagcccgcgagtgggcgcccagctggcttcgcacgggtgaggggctcagcctgcacttccctcctccaccccgaccgccgaacgcgtcccggctggcttcagagtg

SEQ ID NO: 450 - DNA, 371 bp, Homo sapiens
  chr5:72599462-72599833
  hyper
cgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcatt

SEQ ID NO: 451 - DNA, 92 bp, Homo sapiens
  chr5:76249579-76249671
  hyper
ggggggcagagggctcgcggacatctcggggaaggggctggccggaaccgccaggggcgcggtccccttagctaaggatcggtccgcggagg

SEQ ID NO: 452 - DNA, 212 bp, Homo sapiens
  chr5:76249695-76249907
  hyper
cgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggc

SEQ ID NO: 453 - DNA, 174 bp, Homo sapiens
  chr5:76249944-76250118
  hyper
cgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtg

SEQ ID NO: 454 - DNA, 345 bp, Homo sapiens
  chr5:76923679-76924024
  hyper
ggaagcctgtgatatcgatttgcctccaagtttaaaacacaccgcaaaccttcccctcggccgaccgaagaaacggcatttttttcctactcctttggggcagtcccctgagcacgtgcctgaagtcgaggttagtacgcagccagcagggaccctgacaggaaaccagagcagccccggggttgggggagccctggtaggtgctggtcgtcccggacacgcctcttctggagaagcgcgtttgtcccttacttgggaggtcccgggtatctgaagcggatcccgggtctggggacatgaaggggcgccgtggccttagggaaggccccaaagaggcctaggccc

SEQ ID NO: 455 - DNA, 214 bp, Homo sapiens
  chr5:76924086-76924300
  hyper
cggcgccggagagcagaactccaggctctgaaggccgagggtgcgaattgtggtcccctcccacccacggcctccccatcacgcgcacgcagcccgcgaggggcgccctccgcgccactgccccagggacaccgttcatctgaggaactctcgcgccctgcgtttcgtgccgacagcgacgctcggagtcccacctgggaaacctgggttggcc

SEQ ID NO: 456 - DNA, 323 bp, Homo sapiens
  chr5:76934331-76934654
  hyper
actcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactc

SEQ ID NO: 457 - DNA, 194 bp, Homo sapiens
  chr5:76934676-76934870
  hyper
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcct

SEQ ID NO: 458 - DNA, 602 bp, Homo sapiens
  chr5:76936119-76936721
  hyper
aaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagt

SEQ ID NO: 459 - DNA, 182 bp, Homo sapiens
  chr5:77140529-77140711
  hyper
tgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccct

SEQ ID NO: 460 - DNA, 101 bp, Homo sapiens
  chr5:77147549-77147650
  hyper
aagtgcgtgtgtaggcgcgtgtgcaagtgcgcgcgcgtgtgtttacacttccagaagtcaaatcctttctaggactcccccttgcttcacccggaagtgtt

SEQ ID NO: 461 - DNA, 260 bp, Homo sapiens
  chr5:77147872-77148132
  hyper
gccggggcttcagtgacaccaggcacccgccccgggccgcgggaggaggaaattccctgcaaaatagcaatggttccgagaaaaggatcacaacaaaatattgaataaattcccttttaatttatttgatcattccacattacggggctatgaattgctcaaatttgataacaagtactcaattcaactcattatgtaagttaaattagacttcgataaaatttcagtggcgcgcagtggttcctcgaatgaaatgtaat

SEQ ID NO: 462 - DNA, 280 bp, Homo sapiens
  chr5:77148393-77148673
  hyper
ggagctgacgctgaacgcctgaatgggcagcgcgccaacttcgctgctccaggaggggggtggggagggagaggaggaggaggaggatgaggagagaggggaggtggaaggctgtggtaacggtgggcggaggcgggaccatggcgcatgctccgcgacgtcccgggccgcgggcggaatcccccggctaacctccttgggggtgagactgggtgggatgggggtcggtgggggaagttgcatggggtgttatacccgcccggttacaggccgctgccct

SEQ ID NO: 463 - DNA, 367 bp, Homo sapiens
  chr5:77268367-77268734
  hyper
gctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgc

SEQ ID NO: 464 - DNA, 227 bp, Homo sapiens
  chr5:77268735-77268962
  hyper
gcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgt

SEQ ID NO: 465 - DNA, 364 bp, Homo sapiens
  chr5:82767429-82767793
  hyper
gagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgc

SEQ ID NO: 466 - DNA, 63 bp, Homo sapiens
  chr5:87955602-87955665
  hyper
ttggccagtgcccttcggtgtcactgaagctcagcccgcggacggcggtgtgtcagtgtgcac

SEQ ID NO: 467 - DNA, 495 bp, Homo sapiens
  chr5:87956168-87956663
  hyper
gcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagcctt

SEQ ID NO: 468 - DNA, 427 bp, Homo sapiens
  chr5:87956679-87957106
  hyper
cgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctt

SEQ ID NO: 469 - DNA, 304 bp, Homo sapiens
  chr5:87967773-87968077
  hyper
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactcta

SEQ ID NO: 470 - DNA, 11 bp, Homo sapiens
  chr5:87968675-87968686
  hyper
gcaccggctag

SEQ ID NO: 471 - DNA, 86 bp, Homo sapiens
  chr5:87968772-87968858
  hyper
cgatactcacttgatctccctgcgccaggcaatgctgccccccaaatccagctgggcaggaaccgaggcgccggctgaaagacaag

SEQ ID NO: 472 - DNA, 73 bp, Homo sapiens
  chr5:87970041-87970114
  hyper
gaagggtgggggcttcgaggggaaggtgggcttcctgcaacacaagcggagaggctgtcaggggtgtgggcac

SEQ ID NO: 473 - DNA, 792 bp, Homo sapiens
  chr5:87970115-87970907
  hyper
ggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggc

SEQ ID NO: 474 - DNA, 124 bp, Homo sapiens
  chr5:88185263-88185387
  hyper
agtgtttctagagctcggaggctgctggtagggggtgagtgcgccacgtgcgtgcgccacgggcgagcaggaggcaggctctgggccctcctggggacctgctggacctgctggacctgggtgc

SEQ ID NO: 475 - DNA, 399 bp, Homo sapiens
  chr5:88185388-88185787
  hyper
acgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccatttt

SEQ ID NO: 476 - DNA, 248 bp, Homo sapiens
  chr5:112629488-112629736
  hyper
cagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaac

SEQ ID NO: 477 - DNA, 173 bp, Homo sapiens
  chr5:115151185-115151358
  hyper
cgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcagg

SEQ ID NO: 478 - DNA, 736 bp, Homo sapiens
  chr5:115151649-115152385
  hyper
cgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaag

SEQ ID NO: 479 - DNA, 61 bp, Homo sapiens
  chr5:115152616-115152677
  hyper
ggcctaacgcctctccccgctccacctccgccgctgtggttcgcgacgctgggacgtagac

SEQ ID NO: 480 - DNA, 102 bp, Homo sapiens
  chr5:127873552-127873654
  hyper
gagcggtacacgttgcataaccggcctaaagccccgagcgactccaggaccgtcagcgggcgggggaggaaattacaaaagccctggcgtaaaatttcaaaa

SEQ ID NO: 481 - DNA, 112 bp, Homo sapiens
  chr5:134385952-134386064
  hyper
ggagatcaagagtggcgcggcagggggagagcgccctgagcctcgctggagcccatcccggcatggctgctgggaccgacaggccgatcgcgggccgcgagcacatctcaca

SEQ ID NO: 482 - DNA, 512 bp, Homo sapiens
  chr5:134879478-134879990
  hyper
cctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaatcccagttactcgggag

SEQ ID NO: 483 - DNA, 123 bp, Homo sapiens
  chr5:135265737-135265860
  hyper
cccagaaaccacaagcgttggctcatgcctgtgtggagtcacaggcaggtggccacggggaattagctgaagaccagcaggcaggaagcctcccacatgccacctaaggggcgctcccggaac

SEQ ID NO: 484 - DNA, 12 bp, Homo sapiens
  chr5:135265919-135265931
  hyper
cgccaggtgggc

SEQ ID NO: 485 - DNA, 197 bp, Homo sapiens
  chr5:135265932-135266129
  hyper
ccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggactccagcaccttggcc

SEQ ID NO: 486 - DNA, 110 bp, Homo sapiens
  chr5:135266577-135266687
  hyper
ggagtttatagttgccacaaatgtcaaaaagtagccttctggcgagctgaaagcgctcacctgtgcgctttaaggtgtaccgtctttgtctttggcgagtgtgcctttta

SEQ ID NO: 487 - DNA, 228 bp, Homo sapiens
  chr5:140801034-140801262
  hyper
cgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcct

SEQ ID NO: 488 - DNA, 861 bp, Homo sapiens
  chr5:140855598-140856459
  hyper
gcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctc

SEQ ID NO: 489 - DNA, 87 bp, Homo sapiens
  chr5:140856546-140856633
  hyper
cgccggcgtgcggcaactattcgccttagaccttgtaaccgggatgctgacaatcaagggtcggctggacttcgaggacaccaaact

SEQ ID NO: 490 - DNA, 92 bp, Homo sapiens
  chr5:145722375-145722467
  hyper
tgaaaatttaaaatacggctgatgcaatattaattgcctatagtggtataaaacacagggcaggagcccagccgggctgcagaggagacaac

SEQ ID NO: 491 - DNA, 467 bp, Homo sapiens
  chr5:145722560-145723027
  hyper
cgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggt

SEQ ID NO: 492 - DNA, 151 bp, Homo sapiens
  chr5:145725693-145725844
  hyper
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctc

SEQ ID NO: 493 - DNA, 375 bp, Homo sapiens
  chr5:158527442-158527817
  hyper
tcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 494 - DNA, 251 bp, Homo sapiens
  chr5:158527818-158528069
  hyper
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggc

SEQ ID NO: 495 - DNA, 100 bp, Homo sapiens
  chr5:170735131-170735231
  hyper
ggaagaaaatgattccgcttgtctccccaaagctgcagcggaaggtgactacttcgtgtgcggtcctgtccacggtgccctgggccgggtagacagtcac

SEQ ID NO: 496 - DNA, 116 bp, Homo sapiens
  chr5:170736715-170736831
  hyper
cggtctccagccttggcggtctcaatttcccctggatggagagcagccgccgcttcgtgaaagaccgcttcacaggtgagcagagctggcgaccaggctccaggcctccgccctct

SEQ ID NO: 497 - DNA, 454 bp, Homo sapiens
  chr5:170737281-170737735
  hyper
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccacccccgccccaaacacacag

SEQ ID NO: 498 - DNA, 69 bp, Homo sapiens
  chr5:170737795-170737864
  hyper
cttcttccagcccgccctctcggattttcaacaatcctcgtggacgccggtttcctctccccccatctc

SEQ ID NO: 499 - DNA, 755 bp, Homo sapiens
  chr5:170737935-170738690
  hyper
cgtctggaaaggggttcaagacaggccctgggcgaactggatgagactgacccagcccccgggcgtcgtgcgggtggtgcagagccagcctgctcacccgcggaccccagcgaccccggttcccgcagggccaagtcagttacacataggccctgcccttgctatctggcgaaaggaacaatctttattgttggtgaagccacaatacccgggcgtgcaggtgggcggcgggcagagtcccctcctggagaccctctggcacacaacaaaaacaaatgatcctaaccggctccctggatataagagcctcgggcgtaaagcgcgggctgggaggcagacgggttctgcgcctcgaggctcccggatggcctcggctcccgggagggccggggccccgccggcggccccgcggtgccgggtgcatgacggtactgtccctctccctcccccggtgcaggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccgg

SEQ ID NO: 500 - DNA, 1116 bp, Homo sapiens
  chr5:170738823-170739939
  hyper
cgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttcc

SEQ ID NO: 501 - DNA, 152 bp, Homo sapiens
  chr5:170742448-170742600
  hyper
tggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggc

SEQ ID NO: 502 - DNA, 166 bp, Homo sapiens
  chr5:170742672-170742838
  hyper
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccg

SEQ ID NO: 503 - DNA, 342 bp, Homo sapiens
  chr5:170743138-170743480
  hyper
gaaagtaagcttcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 504 - DNA, 482 bp, Homo sapiens
  chr5:170743646-170744128
  hyper
cgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaaggccgcagagcggctggtgtggtgcaggcgcctgcgttctggagtagtgaaggttcctccacagggaaggcggttttccttccgtgaaattcgaaattcagccccccagttccaagcgcctgctccgttaatagcatctactctcagcgacgcccagacccaggctgtgcactgtcttggctcagacactggcaaagtcctcgagaaattgccttggtgatcggtgccttccctcgggccacccagccgccggtggcacggagtcttccgcgcagttgtgcggaccctcgctgtgtggccctg

SEQ ID NO: 505 - DNA, 171 bp, Homo sapiens
  chr5:172659855-172660026
  hyper
ggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 506 - DNA, 77 bp, Homo sapiens
  chr5:172660141-172660218
  hyper
cgcccggggccgctccgcgttgtccgcctctgtcttctccagctccaccgccttctgcagcgcgcacagctctgagg

SEQ ID NO: 507 - DNA, 87 bp, Homo sapiens
  chr5:172671395-172671482
  hyper
agccctgtgctgctgcggccggctcagtgctgaattgatgctggaaacggctggccagcgggcctagggtcgccgcctttccctcct

SEQ ID NO: 508 - DNA, 153 bp, Homo sapiens
  chr5:172671639-172671792
  hyper
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggatt

SEQ ID NO: 509 - DNA, 303 bp, Homo sapiens
  chr5:178016681-178016984
  hyper
cgggaccctgaggccggagcggagaccgcaaaaccccttggggccggcaccccctgcctccgccttggcgcagacgtgcccatctctgggacggccccgagcgcacgcagccggcgggcgaccctcctcccagagacctgcacgctgcccccggctcccagcgtaccgccaccctcaacccgacacacccaagtccgccccagccacgcgccaagacgctcacctcccgcagcaggcgctccaggtgcggctcggcccaggcgtccagggcgcctggcggccccgcgcgccgcagcagctccc

SEQ ID NO: 510 - DNA, 52 bp, Homo sapiens
  chr5:178017519-178017571
  hyper
cggcgccgggctgatcccacgcgcagcgcgcacctctgccctcacctagccc

SEQ ID NO: 511 - DNA, 111 bp, Homo sapiens
  chr5:178017572-178017683
  hyper
ggcgccggcacccgcccccgcacgcacctctgaggcttccccagcccaagcccgcactgtggaccccagaggtcggaggggagcccggcgacaccgcgccccttctgcagc

SEQ ID NO: 512 - DNA, 44 bp, Homo sapiens
  chr5:180075814-180075858
  hyper
ctgtcccctcaaatccggggacccctggccttccgccccttctg

SEQ ID NO: 513 - DNA, 405 bp, Homo sapiens
  chr5:180076053-180076458
  hyper
cgcacccaagtccggggcccggccgggatggatctccggcgcgcgtgggtcgggacggcgcggcgcggggaccccgcggggaagcgagtaagggcgcgaaggatccgggctcagcgcgcagcccggcagggcccggctccgaggacgcggagccaccgacggagacgcggattcaggggccgggagagctacccctgcgccgaggcgcggcccggccgccctggccctgacccggctgcggtccccgcccgccccttcctcatcccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgct

SEQ ID NO: 514 - DNA, 314 bp, Homo sapiens
  chr5:180076532-180076846
  hyper
cgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagc

SEQ ID NO: 515 - DNA, 534 bp, Homo sapiens
  chr6:391209-391743
  hyper
gagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 516 - DNA, 20 bp, Homo sapiens
  chr6:391744-391764
  hyper
cactctcagtttcaccgctc

SEQ ID NO: 517 - DNA, 135 bp, Homo sapiens
  chr6:391765-391900
  hyper
atcttgggacccaccgctgccctcagctccgagtccagggcgaggtaagggctggagtcgggcaggaggaggggtgtgaggctgataccagagaggacccggagcgcgaaccagaggttcgacctccagggcagc

SEQ ID NO: 518 - DNA, 25 bp, Homo sapiens
  chr6:392409-392434
  hyper
gctctcccgggcctgctccggggtc

SEQ ID NO: 519 - DNA, 372 bp, Homo sapiens
  chr6:392587-392959
  hyper
cggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcc

SEQ ID NO: 520 - DNA, 115 bp, Homo sapiens
  chr6:393124-393239
  hyper
gggcgcgggcgcggacggcacgcggggcatgaacctggagggcggcggccgaggcggagagttcggcatgagcgcggtgagctgcggcaacgggaagctccgccagtggctgatc

SEQ ID NO: 521 - DNA, 233 bp, Homo sapiens
  chr6:393240-393473
  hyper
accagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcgggg

SEQ ID NO: 522 - DNA, 53 bp, Homo sapiens
  chr6:1384127-1384180
  hyper
aggggagttttgatgcgccaggaagttcatctatcgcccaggcgctcaggacc

SEQ ID NO: 523 - DNA, 19 bp, Homo sapiens
  chr6:1384625-1384644
  hyper
cgagcgttgccacagccgg

SEQ ID NO: 524 - DNA, 261 bp, Homo sapiens
  chr6:1625257-1625518
  hyper
caaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttag

SEQ ID NO: 525 - DNA, 260 bp, Homo sapiens
  chr6:6003269-6003529
  hyper
aagcctcaggcttggcgctctgtccttggtgggcgctcagcaaacactgctgaatgaatgaacgaatatagtccctggaagccaccagcagttaccgaaatggattgtttcattataaaaccgattgcctaccgtggactctgtattccgagtgagaccctcggatgcaccctctcccgccccgctggaaagagggcagcctggacgtcctgagacctggcgcggatgatgagtggtctggagaggagaaggccagaggc

SEQ ID NO: 526 - DNA, 395 bp, Homo sapiens
  chr6:6004349-6004744
  hyper
ggaacgggaagcactggggaagggaccgaggttaacttcgacctccgctggggcagatacgtaaaccttctcaaacctccgagttcaccttacagcgaacattaaatacccttgcgactacaatactaacaaatcgaacactgacgtaaaatcttaagaataaacgaatctttgttctgatagagctcgttcaaaatggaaatacactccacacatcttcctctataacgcatgtcacaaatacagctttgcagagaagaaacgaaataaaataaagtccaatctccccgtccacgtctctccccaccccttgcctacacccccaaaactcagtggcgaaagaagcccctaaaatgcattgacattttttaaggggaattggggctcgccggggg

SEQ ID NO: 527 - DNA, 329 bp, Homo sapiens
  chr6:6004836-6005165
  hyper
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaaccc

SEQ ID NO: 528 - DNA, 192 bp, Homo sapiens
  chr6:6006691-6006883
  hyper
tgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggc

SEQ ID NO: 529 - DNA, 86 bp, Homo sapiens
  chr6:10381507-10381593
  hyper
ggatgaaaggagagccgtccacccagcgaggggcttgtgtgccctagagggcgctgggccccgcgcgctttcctggctgtccccgc

SEQ ID NO: 530 - DNA, 138 bp, Homo sapiens
  chr6:10381831-10381969
  hyper
taggctcttgtccttcgacgcccccttggcacaagcgcactggcgccctccgctcaacccaccttgcctttggggcgggcttcaaccctgggaagacaggcctgggggaagcgagaggagaggcccgaatagaggttc

SEQ ID NO: 531 - DNA, 1050 bp, Homo sapiens
  chr6:10390023-10391073
  hyper
ggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcag

SEQ ID NO: 532 - DNA, 103 bp, Homo sapiens
  chr6:10417427-10417530
  hyper
ctttcttgccctctgcgggcttggaaaggccgccctccatcctctgccaccccatttcaacccccgtttccacctccccgctgccccgcgcccaacagatctc

SEQ ID NO: 533 - DNA, 363 bp, Homo sapiens
  chr6:10419077-10419440
  hyper
tctcctacagaaacacgctgcctccgcgacccagccatctggacccctttccattcttcacacatcctagatctcccgaaatctgggggtaccaagagagacaggtgcaccagaacctgtccaacactcaaccctggggtctagggcgaggccgcaggcgcagcaggctgaaaaccttcaccgccgcgcaccacaaccccaggccttctccctccccccttccgaattagtcatcctcccaagtttctacttgaggtgggaggggggtgggggaaacggccacagcacaaaccacaagtgacccaccaggccacctgtggagcgtgcgccggacttccccggcgccgggccccgcgggctgcg

SEQ ID NO: 534 - DNA, 56 bp, Homo sapiens
  chr6:10419476-10419532
  hyper
cgtttttcctgtcttcgctgtctcctgggagctctcctgggcgctgccaggcgcgc

SEQ ID NO: 535 - DNA, 96 bp, Homo sapiens
  chr6:10421356-10421452
  hyper
ctggctttttccagacggtggaaatagggcggtgactaacttttcagagtggaagacacgcacgaagggcgcacctgcagctctccgggattcagg

SEQ ID NO: 536 - DNA, 568 bp, Homo sapiens
  chr6:10421548-10422116
  hyper
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccc

SEQ ID NO: 537 - DNA, 157 bp, Homo sapiens
  chr6:26327825-26327982
  hyper
gccgagtggttaaggcgatggactagaaatccattggggtctccccgcgcaggttcgaatcctgccgactacggcagtgggtttttgcatcttcaagcaggtttcatccgaccgatcgatatttcacgtgtaaaaaggctttcgatcttttacaagt

SEQ ID NO: 538 - DNA, 240 bp, Homo sapiens
  chr6:26501949-26502189
  hyper
cgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttc

SEQ ID NO: 539 - DNA, 15 bp, Homo sapiens
  chr6:27228172-27228187
  hyper
gaagagcccacctgc

SEQ ID NO: 540 - DNA, 170 bp, Homo sapiens
  chr6:27228289-27228459
  hyper
cgctgcagtctcagagttggagcagcttggcgtttactcccgggcctttcccggatgggagaaggaacctgcgcgggaacttgaattttttcgagtcagaatcagcaagttgttgttgtttgagaccaagtgagccaccgcacccagccaagaatcggctgtttaagaaa

SEQ ID NO: 541 - DNA, 725 bp, Homo sapiens
  chr6:27279795-27280520
  hyper
gtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcagga

SEQ ID NO: 542 - DNA, 123 bp, Homo sapiens
  chr6:27512761-27512884
  hyper
gtttccatctttttgcgtttttctgtgctggactctccctaagatatttggaaacctgtgttctgagttcttccttttccccgggctcgggtggctgaaggccttggctcttgggaatggtct

SEQ ID NO: 543 - DNA, 151 bp, Homo sapiens
  chr6:27512994-27513145
  hyper
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccat

SEQ ID NO: 544 - DNA, 225 bp, Homo sapiens
  chr6:28367054-28367279
  hyper
gcttccctctaacctcgtggtctgtgattataatctgaagtgaggaaggcccaggaaagggtccctaggacgccggcgagcgtctgtgacccaccactgtccagaaatgtcggtaagcgctgaacccaaggatacacagcccgaagcaaacgcggaaggtatgggccttacagcctggaattgctgcagagactgggagccaaaccctcatcctaatgtcccaac

SEQ ID NO: 545 - DNA, 67 bp, Homo sapiens
  chr6:28367280-28367347
  hyper
cactttggggagggagagcttcccgcggatccgcctgggtttgggaggaccggggtccactctgcac

SEQ ID NO: 546 - DNA, 81 bp, Homo sapiens
  chr6:28367490-28367571
  hyper
cgaacccttttgggacccggaacccatcaaaagtgacccacaaaggccggaagcggccacggggggtctaagaaccagccc

SEQ ID NO: 547 - DNA, 243 bp, Homo sapiens
  chr6:28367572-28367815
  hyper
cgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactt

SEQ ID NO: 548 - DNA, 16 bp, Homo sapiens
  chr6:28411014-28411030
  hyper
agcccttccaggctgc

SEQ ID NO: 549 - DNA, 57 bp, Homo sapiens
  chr6:28411031-28411088
  hyper
gagcaacctcctctgcccttcacctgcccggcccatctctggccaagaagaccctgc

SEQ ID NO: 550 - DNA, 241 bp, Homo sapiens
  chr6:28411151-28411392
  hyper
cggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaa

SEQ ID NO: 551 - DNA, 187 bp, Homo sapiens
  chr6:36252984-36253171
  hyper
gggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctc

SEQ ID NO: 552 - DNA, 304 bp, Homo sapiens
  chr6:50691909-50692213
  hyper
ctcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcc

SEQ ID NO: 553 - DNA, 213 bp, Homo sapiens
  chr6:50692299-50692512
  hyper
cgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtct

SEQ ID NO: 554 - DNA, 318 bp, Homo sapiens
  chr6:50791177-50791495
  hyper
cccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 555 - DNA, 36 bp, Homo sapiens
  chr6:50791550-50791586
  hyper
cggccatcccggaatggaagacgtccaggtaaccac

SEQ ID NO: 556 - DNA, 216 bp, Homo sapiens
  chr6:50804152-50804368
  hyper
gcgcttgggaggatccgcggccgccacctgctcgcccacaaactctagtgtccttgcatccaggcctgcccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccc

SEQ ID NO: 557 - DNA, 87 bp, Homo sapiens
  chr6:50810627-50810714
  hyper
tcagtcccagctgctcgagaagggagggcgctgggaaaggaaacagagcggaatcgcccacattagcctcgctcttcggtgacccgg

SEQ ID NO: 558 - DNA, 490 bp, Homo sapiens
  chr6:50813325-50813815
  hyper
gagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatg

SEQ ID NO: 559 - DNA, 527 bp, Homo sapiens
  chr6:56818720-56819247
  hyper
cagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatg

SEQ ID NO: 560 - DNA, 420 bp, Homo sapiens
  chr6:62995455-62995875
  hyper
aatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccc

SEQ ID NO: 561 - DNA, 53 bp, Homo sapiens
  chr6:62996077-62996130
  hyper
cgcagagccccggctcacaccagcggccttaactggagaggcgggaacaggac

SEQ ID NO: 562 - DNA, 83 bp, Homo sapiens
  chr6:62996131-62996214
  hyper
cggcccacctccgccaaccactcattggtggtggtgccaggagaggcggggcgctggcagaaggccgcgggctctcattgggc

SEQ ID NO: 563 - DNA, 181 bp, Homo sapiens
  chr6:62996215-62996396
  hyper
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgca

SEQ ID NO: 564 - DNA, 150 bp, Homo sapiens
  chr6:73329801-73329951
  hyper
tttaaagcgggcacacgagtcattttaagtctctagatctttcaccctgaaagtccctgcacagaaactccatagggagtctaaatatagcaacagcaccccctcccgccccctccgccttcagtcagggtcccgcgcagctctaggatt

SEQ ID NO: 565 - DNA, 164 bp, Homo sapiens
  chr6:73330950-73331114
  hyper
agtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgc

SEQ ID NO: 566 - DNA, 123 bp, Homo sapiens
  chr6:73331115-73331238
  hyper
ggaagatgcctggtccttgcctcgcggacttggcagccgcgtcctgcgggtctgtccactgaactgctgaggactcgcccgtgtgcggggacccgagtgccacttcccggagcgttaccttgc

SEQ ID NO: 567 - DNA, 390 bp, Homo sapiens
  chr6:73331239-73331629
  hyper
ctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagc

SEQ ID NO: 568 - DNA, 272 bp, Homo sapiens
  chr6:84417429-84417701
  hyper
attatggaccaagagcgcaggccgcaccaccagcatcccaggcgcctctgccgtgcgcatgtccctcttatataaagagatgcttacagtccaggtgctttttcttggggcccattacttcatgagtagtggctttgcagaccgctcttgctacagcagagcctgtaacgctgtactgagcggcggcgatccgatccgtgagcgtttggcccgacatcttctgtggtcgcgtctaccgcctcctcttctgcaggaaacaaggggagacggtc

SEQ ID NO: 569 - DNA, 866 bp, Homo sapiens
  chr6:85472401-85473267
  hyper
cttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgctttta

SEQ ID NO: 570 - DNA, 694 bp, Homo sapiens
  chr6:85473508-85474202
  hyper
ttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaa

SEQ ID NO: 571 - DNA, 119 bp, Homo sapiens
  chr6:85482703-85482822
  hyper
gcaggaatcggactccgccaggggttcggagtcttctggggaaagggcgtgttgggagagaaaggcaagcccacgcaggagcgacctcctaattaattcatcatcgagaattctccagt

SEQ ID NO: 572 - DNA, 736 bp, Homo sapiens
  chr6:99271926-99272662
  hyper
ccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaa

SEQ ID NO: 573 - DNA, 150 bp, Homo sapiens
  chr6:99277180-99277330
  hyper
tagggggagaaaatgcgagcgtgcctgtgtgtgcgtgtgcgcgcacacacacgcgcgcgcacacacacacacagacacctttaggctccattgttaagaggtcatttaactgttagtcctttgaaagtgaaattgcgggaagcaaactgg

SEQ ID NO: 574 - DNA, 105 bp, Homo sapiens
  chr6:99295759-99295864
  hyper
agtcgccgggagtggcgctgcggtgaaagccggtgcctagagtgggcttaggggtcccattccactcggaaagtcctctcacctccccaagggccattctgccgg

SEQ ID NO: 575 - DNA, 304 bp, Homo sapiens
  chr6:99296061-99296365
  hyper
cgcttccgccctcccggcctccctcttgccgcatgagcagcgcagggcctcctgggctgtgctggggtcaagagttatgaacacttcgtgtcctcaggagctcacgggggtgacgagaggcggtctgggtctgaagccgctacacagaggggagcagtggggcctcggggagcagcggggcctcggcttggcggctccccccgccaccccgccacctttcaggacccaggccaagccgcctcacgaagaccaggaagcggcctctgccgggaagccacctgcagcctatagtcccctccccaag

SEQ ID NO: 576 - DNA, 49 bp, Homo sapiens
  chr6:99296407-99296456
  hyper
cgcctggagggccctgacccttccggtgttccaccgcaatggggtcggg

SEQ ID NO: 577 - DNA, 46 bp, Homo sapiens
  chr6:100038661-100038707
  hyper
cttcctcccactgtgcgagcttcggaaccctaaggccggttcactg

SEQ ID NO: 578 - DNA, 369 bp, Homo sapiens
  chr6:100038785-100039154
  hyper
cggtggtgcccggcgggggtggggtgcccacggacgcagccgcctagctctgccggccgtcctgaggcagctgctggcgcccgccgggaggcgcgtggccacttgcacttcagcgcgcggttctctctccgcaggctgctttctaggatttgaaagggccatagcgacagaagtcgatctctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccc

SEQ ID NO: 579 - DNA, 251 bp, Homo sapiens
  chr6:100050858-100051109
  hyper
cgctgacttttctttgcaccatgtcaaccgaaagaaccaagaaataagttggagaactccggttaaaaggcaacttgagagggattctgaatacttttattgagccgtttccaacggaggacttaaaaaacaacaaaaaaggcaccacaaaacccaccagcggcgtccgggctgcgtcctggctgccactttggagcctcccggccgccgcgcatccaccggccatgcaattaaggggaaaatggcctcat

SEQ ID NO: 580 - DNA, 149 bp, Homo sapiens
  chr6:100051359-100051508
  hyper
cgcggctctctgcatccccgggttcaggactcctccggccccagttttgggattccgcgttgacctaggagggaggggtgtttggtgagtcaccagcaccagggtctccaaggctgagcccgcctccccaacccccgggacaactccct

SEQ ID NO: 581 - DNA, 187 bp, Homo sapiens
  chr6:100051771-100051958
  hyper
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacg

SEQ ID NO: 582 - DNA, 2 bp, Homo sapiens
  chr6:100441306-100441308
  hyper
cg

SEQ ID NO: 583 - DNA, 241 bp, Homo sapiens
  chr6:100441497-100441738
  hyper
cggggccgctgcttcccggaaagccactccctttttcttttcccacctgtgtttccattttctttgccgagtgtgaaaccagccggccacccacccgccccgctccgtctcgtaggtgcctccacagagccaaactttgtaccttctggggatggagggggatcccccagcaatcagacactaccggcgagccagccccggggaggggcgactggtggaccaggcgccagaccttcccggg

SEQ ID NO: 584 - DNA, 337 bp, Homo sapiens
  chr6:100441761-100442098
  hyper
cgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttc

SEQ ID NO: 585 - DNA, 132 bp, Homo sapiens
  chr6:100912919-100913051
  hyper
tagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 586 - DNA, 104 bp, Homo sapiens
  chr6:105389509-105389613
  hyper
gggcaggcgtcggggatcgtttttgctttggtatcggtgatgtaaattcatgaattaaaattaaggattttgaaaagaacggggaagaacgcacttggatttag

SEQ ID NO: 587 - DNA, 83 bp, Homo sapiens
  chr6:105584133-105584216
  hyper
gtctggccaacaacccgttcccaaaggctcggggaaggaggttgcgggtgggtggcgcggacctcgggtccccagccatcggc

SEQ ID NO: 588 - DNA, 103 bp, Homo sapiens
  chr6:105584217-105584320
  hyper
ctctcccggggccctctgacctcgctccttaaaggaggagggtccgtggcaacggtcctcctcggccaggcgctctcgggacgcgggggtgaggagtgagcgc

SEQ ID NO: 589 - DNA, 185 bp, Homo sapiens
  chr6:105584366-105584551
  hyper
cgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagc

SEQ ID NO: 590 - DNA, 1015 bp, Homo sapiens
  chr6:105584552-105585567
  hyper
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctc

SEQ ID NO: 591 - DNA, 427 bp, Homo sapiens
  chr6:106429049-106429476
  hyper
ctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttat

SEQ ID NO: 592 - DNA, 35 bp, Homo sapiens
  chr6:106429589-106429624
  hyper
cgggctctgccattcctatccggaaaattcaagct

SEQ ID NO: 593 - DNA, 1251 bp, Homo sapiens
  chr6:106441869-106443120
  hyper
tcctaatttatgaaacgtgaacgggggtaaggtatttatttgtacgctagttgaagtggggcaggagcactgattcctggacagtcactcaaaagctgcgcccaaagttttaaaaagcgcggggacggtggagagggaggcgaagagcccgcgctgctgggctgggctcgggtgccgcgctggggacgccgcatctactgagcggtcgccgaagacgccgggaggcgaggggcgaggtaagacgccgcctaaagaggcccgggctctcccccggggtcgttgttggaaaagcaaattccacggtgaactctaccaagctcagcgcgtacacagctagcggctctggattggactgcattcgcctaaattgcgtaattaaaaaaaaaaaatacaccactgccaccctacagcgacgcttccgctggaagacgagcggggacgcgtgacagcgcggggatagcttttctattacgtttcttgttctccgagctcgagcccccttttaaaaagtcgctcaccaaaaacggggtgggggatggaggtggggacgagaagtttccgaatgctgagttcatttggacgaggtgaggagaactagggtcctaacagcaggtccagaggactctcgagataggtttagagcccgtccttttgtctggagtgtcgcgggactccagaagtgggttgtgcaagacaaacttccagataaatctttgcccggatcctcctgcggtcaaagcatcagtcctgcccgtaacttcctaacgacatcttcttggagcagattccgcggcggggatggctgggtgtgcaaaccgaaaacagtttgtcagccctccagtcccgccgcgtcgggaatgcgagcccggccacgcggtccgaccgggtccggggacggcgcgcttgtcgcgggagcctcccggcttgcggagggcttgagttttttggcggagacagaggaaagcctctggtcgagaggattagagcgcgcgttttctccgccgagcacgctgcccgacgccgtcgcagccgcgcacttcccggttttgaaagccagagagatgagtcaagcgcaaaagctccggagtgacaatgcgagcttttggccagcctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 594 - DNA, 15 bp, Homo sapiens
  chr6:108438142-108438157
  hyper
gcagcccaactgggg

SEQ ID NO: 595 - DNA, 303 bp, Homo sapiens
  chr6:108438260-108438563
  hyper
cgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggc

SEQ ID NO: 596 - DNA, 567 bp, Homo sapiens
  chr6:108440078-108440645
  hyper
cctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccggg

SEQ ID NO: 597 - DNA, 223 bp, Homo sapiens
  chr6:108440744-108440967
  hyper
cgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtg

SEQ ID NO: 598 - DNA, 665 bp, Homo sapiens
  chr6:108487779-108488444
  hyper
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctattt

SEQ ID NO: 599 - DNA, 79 bp, Homo sapiens
  chr6:108489730-108489809
  hyper
tgcggaaactttggccgttctaacttgccaagagcctgagtgaggccttggaagcctccagccccggctcaggtcggga

SEQ ID NO: 600 - DNA, 180 bp, Homo sapiens
  chr6:108490066-108490246
  hyper
cgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggct

SEQ ID NO: 601 - DNA, 219 bp, Homo sapiens
  chr6:108490296-108490515
  hyper
cggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtc

SEQ ID NO: 602 - DNA, 60 bp, Homo sapiens
  chr6:108490537-108490597
  hyper
cgaggaggggcccccaccctgcactggtcttccctccaccctcatcgggttctccagaga

SEQ ID NO: 603 - DNA, 551 bp, Homo sapiens
  chr6:108495915-108496466
  hyper
cggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggcc

SEQ ID NO: 604 - DNA, 208 bp, Homo sapiens
  chr6:117086271-117086479
  hyper
ggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 605 - DNA, 160 bp, Homo sapiens
  chr6:117086480-117086640
  hyper
ccctcaagccgactcccgggccggcccctcgctgccctcccgcaacctcctccctcccaggacctccccgtcggagccctggctcaccgtgaccttggggcccagaattgctgggggccccgccgctggagtagcaggggagaccccggggcggaagagc

SEQ ID NO: 606 - DNA, 310 bp, Homo sapiens
  chr6:117591206-117591516
  hyper
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttg

SEQ ID NO: 607 - DNA, 37 bp, Homo sapiens
  chr6:118229695-118229732
  hyper
cagggtgtgagccggcggcgcccagttattccgaagc

SEQ ID NO: 608 - DNA, 91 bp, Homo sapiens
  chr6:118229733-118229824
  hyper
cccatgccggagggggcgggtgccgatcgccggcgcctccagtgctggaatctgcgtagtggattcaggacgttgacgttttaggatgagg

SEQ ID NO: 609 - DNA, 604 bp, Homo sapiens
  chr6:133563411-133564015
  hyper
tgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagag

SEQ ID NO: 610 - DNA, 437 bp, Homo sapiens
  chr6:134210582-134211019
  hyper
gatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccagg

SEQ ID NO: 611 - DNA, 224 bp, Homo sapiens
  chr6:134211111-134211335
  hyper
cgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacac

SEQ ID NO: 612 - DNA, 35 bp, Homo sapiens
  chr6:137244114-137244149
  hyper
tgaggcagagagagccggagagctttgagagtggt

SEQ ID NO: 613 - DNA, 231 bp, Homo sapiens
  chr6:137244235-137244466
  hyper
cgaccctcgcccatgcttcacccggcatcgcccttcctgtcgccccctctcctggtcttcccctgtcaccccattctccgggagaggtgggagggccgcctgagcctgggagctggagtcctccaagcctggaccaagccggaaggagggggccgtgaacttccttgggtcacgaggggctggaatggaggtgggggatgggggcgaagctgagggttcccggggctactg

SEQ ID NO: 614 - DNA, 258 bp, Homo sapiens
  chr6:137809108-137809366
  hyper
gcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgc

SEQ ID NO: 615 - DNA, 472 bp, Homo sapiens
  chr6:137809445-137809917
  hyper
cggctctcttccaggggctgtgatccgggtcggccagggagagcgaggccccggggtcctctgtgaggtccccagcgaagagacgcagctggggaaggcgccgcccccgggccccctgcgccaccctaaccgggcctctccttagcaaagttgacaaattcttgagagtgtcagcccagggctgcgcgtgagggcgctgggaccggggaggaaagagcacctgccgcgctcagcccgactttgaatttgtttgttgttaccgtttttgtttttcctcccagtttccataaacgcttagtatttcgaggcactttgcaggtgttggcgcaggtgatgatgggcctcgttggactctgcctcccacgcatccttttgttttctgcgcgccagcctgtctgactgtgtcctgcggggaccccgagacagtccggggtcagggcgtagagactcatgcttgccacttgacccatcc

SEQ ID NO: 616 - DNA, 929 bp, Homo sapiens
  chr6:137810032-137810961
  hyper
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctc

SEQ ID NO: 617 - DNA, 151 bp, Homo sapiens
  chr6:137815020-137815171
  hyper
atccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatat

SEQ ID NO: 618 - DNA, 515 bp, Homo sapiens
  chr6:137815224-137815739
  hyper
cggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagccccca

SEQ ID NO: 619 - DNA, 777 bp, Homo sapiens
  chr6:137816459-137817236
  hyper
cttcctggaccttggcgctggcgcaaaacggtgggacggtccgcgcccgaagctccgccgggcctcctctggccgctgtgctgacgtgccccgagctccgggaactcagcggcaccccggcctgcgcgggtgggtccaccaggctggggccgccgtacggcgtcggacagggaaatcagaagctcataataaactatctgatgtcggggtggtggggcgggggggtggggtgcgtgggcaaagaagcacgggggaagggaaacaacgaaaggacctagaaagccccttgtgcgtgcccgggcactgcggttcagcgcagagtcgtttctgggaataaagaggaggtcggagtttggagccttcggtgcgagtgcggaggtgggcgtagatctttcttcccccttgctgtgtttttgtgatcaagactttagctcagcagcacgaggggcgggaaggcagaaatcccgggaagggagagagccccaggagtggtctctagaagaacccggacaccgcccctctcccggcttggtggaacgggaaacaaacgctagctagtgactgagagtctcggtggaagtgtgaaatcgaatcaatcgcggaacctcgggcacttggggcctcttgcgccgctgagtcacttcgaagaacaggatgcccccctttcccttgactcaaaccgagcggtcagtgggagagggatgcgcgcccaggtccggagtttgcacgctctgaggctgtgccccactgacagtcacgctgcgaaggcagctctgg

SEQ ID NO: 620 - DNA, 94 bp, Homo sapiens
  chr6:137818505-137818599
  hyper
ggcttgacaactagacgaggggagtgagtaaaggtgccacaactttgcttaccgtaaaatgggttaatactcgccggggcccaaaaggctgagt

SEQ ID NO: 621 - DNA, 649 bp, Homo sapiens
  chr6:137818618-137819267
  hyper
cgtggagtctcttttcgacccccgccaccgcagctcagttcctcggattgagccctgaacccgagaaggagcaggcccggagctcaggagggcaggcacacggatttctttctgagggctgactaccaacgcccaccccagacttgtacggaaggagagagtaaaggagtcgccgcctggccaaggctgcagcagcctacagaggctcagccggagacgcaccatgaccttggccctggccgagacccctttcggagggctcagaccggcgaggagccggagcgagcgaccctgctgcggtggctcgggctgcgctctctcgggccacaccccgcgccctcgcggctggggcgggctgcgccgcggaggcggggatcgttctccggcaacaggtgcgtcccaaggcaggcaggctacttccctccaagcctgtcttggctctgagaagagcctggagtttctcagccttcctacaacatatgaaaacagcgggtcggcgcgtggaccggggcagaagagccgtcctgctgtacccgcgcgcccagggcgctccgcggggaccgcgcactcgggaagctgtgctgtgctcaacacccccctgtgcctcccagatcaccagggatcgtctcttacctgacacccagtgcgc

SEQ ID NO: 622 - DNA, 280 bp, Homo sapiens
  chr6:137819268-137819548
  hyper
ccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctg

SEQ ID NO: 623 - DNA, 52 bp, Homo sapiens
  chr6:150285317-150285369
  hyper
ggttgtggactgcagcgggtttcagaggaggggaggcttctggaaggaccgg

SEQ ID NO: 624 - DNA, 342 bp, Homo sapiens
  chr6:150285544-150285886
  hyper
cggtggctcctttccgccgggtccgcttcctgcggctgctgcttgcccctcaggccaggaggtttctggaaggaccggtgctgtctccccgaacatcgtggtctccccgaacatcgcggcctctccgaacatcgccctctctccgagcaacgcgatctccccgaacatcgcggtctccccgaaaatcgcgatctccccgaacattgccatctcaccgaacatcgcgatctcgccgaacatgcccggctgaaggcactcagttcccctccgcggctcctttccgccgggtctgattcctgcggctgctgcttgccccgcaggccaggaggcttctggtagcac

SEQ ID NO: 625 - DNA, 429 bp, Homo sapiens
  chr6:150286099-150286528
  hyper
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctg

SEQ ID NO: 626 - DNA, 533 bp, Homo sapiens
  chr6:157556764-157557297
  hyper
aaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 627 - DNA, 1231 bp, Homo sapiens
  chr6:166579715-166580946
  hyper
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggc

SEQ ID NO: 628 - DNA, 1021 bp, Homo sapiens
  chr6:166581218-166582239
  hyper
gtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgt

SEQ ID NO: 629 - DNA, 607 bp, Homo sapiens
  chr7:8473635-8474242
  hyper
agaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagc

SEQ ID NO: 630 - DNA, 47 bp, Homo sapiens
  chr7:8474515-8474562
  hyper
cggaggaggcttcttctctagaagttagcgaccggctgtaccctttg

SEQ ID NO: 631 - DNA, 264 bp, Homo sapiens
  chr7:8480763-8481027
  hyper
gaccttaacagtcctcgccgttctaattaaggaaaggcaggcgagcctgccagccgagagcggttgggtcagcggcttcatggtgcagccgagtctcaaagcgggtctgcactctcgcctccctctgcattctcttagccactatttgcctggtcccgtcgcgtgtgtgcaggaagtttcagtcttgatttatccactagtcaagttcccgaccagctctttttctggatgtcagcactaaccccctcccggagcttggtaaac

SEQ ID NO: 632 - DNA, 596 bp, Homo sapiens
  chr7:8483358-8483954
  hyper
agcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaag

SEQ ID NO: 633 - DNA, 37 bp, Homo sapiens
  chr7:19145857-19145894
  hyper
agaactggaaaaccccgtttcctttgagaaacgcgtc

SEQ ID NO: 634 - DNA, 154 bp, Homo sapiens
  chr7:19146031-19146185
  hyper
cggcgcacatttcagcttttcagcttcacggtggagctcgcagtaattgagtcgcgagggttatttttcctggcctcacctcgcggtcctgagcctgcagggagctttcggaaagacatcgccccctccccctgagtccccggcagcttctgaa

SEQ ID NO: 635 - DNA, 345 bp, Homo sapiens
  chr7:19146237-19146582
  hyper
cggctagaggttgaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcggctccagatggacgcccgtaggcagggtcagtttaggaagaccggcaggcaggcgtattaggcgcgcgggctcccatcctc

SEQ ID NO: 636 - DNA, 932 bp, Homo sapiens
  chr7:19146942-19147874
  hyper
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttcccta

SEQ ID NO: 637 - DNA, 8 bp, Homo sapiens
  chr7:19156125-19156133
  hyper
cggccttc

SEQ ID NO: 638 - DNA, 340 bp, Homo sapiens
  chr7:19156303-19156643
  hyper
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagact

SEQ ID NO: 639 - DNA, 43 bp, Homo sapiens
  chr7:19156703-19156746
  hyper
agcccgcagacttcttgccgcgcttgccctgggccgggctgcc

SEQ ID NO: 640 - DNA, 138 bp, Homo sapiens
  chr7:19157055-19157193
  hyper
cggaggagagagcaggaggacggacgggagggacctccgcggggagggcgcgcgggggaggcggggagggaggcgggagggggaggggacggtgtggatggccccgaggtccaaaaagaaagcgcccaacggctggac

SEQ ID NO: 641 - DNA, 69 bp, Homo sapiens
  chr7:19157194-19157263
  hyper
cacaccccgccaggcctcctggaaacggtgccggtgctgcagagcccgcgaggtgtctgggagttgggc

SEQ ID NO: 642 - DNA, 303 bp, Homo sapiens
  chr7:19157264-19157567
  hyper
agagctgcagacttggaggctcttatacctccgtgcaggcggaaagtttgggggcagcagtgtcattggcctgacgtgaggaggagggacttttcgaagttttataggaaagtttccgctttccagtccccctcccccgtcccacctcccttcctcggggtctaacaattcgtcctcccaaaccattcaaaaacgacctggcccgggcggccggcccctccacccgcctcctagccgccctcccccttccctccccgtcgccttcctccggcgggcgcggggcgatttccttccccgccggag

SEQ ID NO: 643 - DNA, 302 bp, Homo sapiens
  chr7:19157633-19157935
  hyper
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatt

SEQ ID NO: 644 - DNA, 156 bp, Homo sapiens
  chr7:20816291-20816447
  hyper
ggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttcctt

SEQ ID NO: 645 - DNA, 70 bp, Homo sapiens
  chr7:20823261-20823331
  hyper
acaaactctgggtctcgggctgccaaaagtcacccccaccaagccccgacagcctgagtaggacgtccgg

SEQ ID NO: 646 - DNA, 497 bp, Homo sapiens
  chr7:20823382-20823879
  hyper
cggctctggaaccaagcagccgtctgcccgggcggcgctgttctgcccaggcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggt

SEQ ID NO: 647 - DNA, 90 bp, Homo sapiens
  chr7:20823919-20824009
  hyper
cgttgcggtgcccgggctcggggggctgcagcagctctggggagtggcagggcgggctgcccgcggcgctgtgctcgctgtcggtgtcgc

SEQ ID NO: 648 - DNA, 545 bp, Homo sapiens
  chr7:22589325-22589870
  hyper
tttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaagg

SEQ ID NO: 649 - DNA, 159 bp, Homo sapiens
  chr7:25896441-25896600
  hyper
cagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgct

SEQ ID NO: 650 - DNA, 278 bp, Homo sapiens
  chr7:25896660-25896938
  hyper
acgcacgcacgcgcgcgcgcacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 651 - DNA, 505 bp, Homo sapiens
  chr7:27135266-27135771
  hyper
acacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccgg

SEQ ID NO: 652 - DNA, 445 bp, Homo sapiens
  chr7:27135979-27136424
  hyper
cgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattc

SEQ ID NO: 653 - DNA, 324 bp, Homo sapiens
  chr7:27136425-27136749
  hyper
acttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctcca

SEQ ID NO: 654 - DNA, 699 bp, Homo sapiens
  chr7:27190372-27191071
  hyper
gggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtt

SEQ ID NO: 655 - DNA, 16 bp, Homo sapiens
  chr7:27195586-27195602
  hyper
atgctatgggctccac

SEQ ID NO: 656 - DNA, 27 bp, Homo sapiens
  chr7:27195866-27195893
  hyper
cgcctttggcgaggtcactgcagagcc

SEQ ID NO: 657 - DNA, 1 bp, Homo sapiens
  chr7:27196152-27196153
  hyper
c

SEQ ID NO: 658 - DNA, 132 bp, Homo sapiens
  chr7:27196154-27196286
  hyper
aagaactcataattttgacctgtgatttgttgtccggcagctttcagtgtcggttttacgaggtagagtgatatatgataacattacacccccagatttacaccaaaccccattttcttttggacggagctc

SEQ ID NO: 659 - DNA, 351 bp, Homo sapiens
  chr7:27196287-27196638
  hyper
ccgcagcacgtgaccgcccacatgaccgcctccgccaatctcagcagtcctcacaggtggtctcgctccgcagggcccgcagccgcctagaatggaagggcaagaggctcaaatatgcggccaaagaatccgcccgcgcccggcgggcctggcgcgtcccgcggaaaaagacctggaggctccgcgggagcgcccagctggcggccaacctccgcactggggtctgcggacgccaggcggcccggccccacgcagcaccccccaccccgcccccccgccgactcctgctagtgagccctggaccaagcttgggatcctccccatccctctcctgtccgcctgcccagaccc

SEQ ID NO: 660 - DNA, 324 bp, Homo sapiens
  chr7:27212660-27212984
  hyper
ggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 661 - DNA, 796 bp, Homo sapiens
  chr7:27213188-27213984
  hyper
gggggctgcgcggggaacgggccagccccgagttgctgcgcgccgccgccgccgctgccatagcccttggcggtgccgtaggcctgagaaaggcggaagtagccaggcactggcaccccgctggaggtgcccagggcgcagccgtcgggcggcgggccccgcgggaagggagccagttcggcggcggtggccgagactttggggcatttgtccgccgagtcgtagaggcagtaggagctctcttctttgatgttctgcgcgaaagagcacgaggtggcctgcggcgctggctggggtggttgcggcgggggcggcggctgctgctggggcggcggcggcggcccgtcaggcggctccatccggcaagaccggggcgcgtctagccacaggtctatgggcgagggcccgtagccgtgcgccccgggacctagacccccgccaccgccaccgctgcccggcgacgctgcctcattgcgcttgccgcccagcgtggggaagagcccgcagctctgcagcccgtagggcaggtcggcggcgggcggcaggtagaccccgccgtgggcgtagtaaccgccaccgccgccgccccccgcgccaccaccaccgccgcctgcctcgcctctgcccgagctgatgagcgagtcgaccaaaaaagagttcgcggcggggctctccgagcatgacattgttgtgggataatttggcgaagggagcagatagccctttctggctgacatttcttgtgcaaaacatgctgaatacgattagcaatccccccgcaccgcggcgggcgccc

SEQ ID NO: 662 - DNA, 277 bp, Homo sapiens
  chr7:27213985-27214262
  hyper
cagccaatcccgagccagagtttccgcgcgaccactcccagtttggtttcgtaggcgcggggccgctctccgagggcgccctcagagcccgcgattgatataaatatgtaatctgtattgatgggccaggagacgcaccccgacaccttggcccgaaggccgggagctgtgggggctgccccaacgtggctggtggggggcctggccattgggctcgccccgcccctacccggacgtgagccccataccggggtcccttagaagggcccttgggccc

SEQ ID NO: 663 - DNA, 378 bp, Homo sapiens
  chr7:27244932-27245310
  hyper
aggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 664 - DNA, 437 bp, Homo sapiens
  chr7:27264875-27265312
  hyper
taggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcg

SEQ ID NO: 665 - DNA, 132 bp, Homo sapiens
  chr7:27279237-27279369
  hyper
gtcgcctccccggggttcccacccacccccctccggcccgggccaggccagcccagccccggcggaagccaagctgggagcttttgaagtccggagaatttcaatccgagaggagccggctggaccggagcc

SEQ ID NO: 666 - DNA, 18 bp, Homo sapiens
  chr7:27279453-27279471
  hyper
cgccgggcctggagcggc

SEQ ID NO: 667 - DNA, 173 bp, Homo sapiens
  chr7:27290946-27291119
  hyper
aaagtcatatccttgcgtcttcatcgagattatttatagcgcagtgagcgctgctgaaaggtatacgctgttaacagggacaattacttaaagggaagcgtttgtaaaatggaaaacaaatgccggggttggtaacaaatgggatcaaaagcagccattccaatctggctccc

SEQ ID NO: 668 - DNA, 537 bp, Homo sapiens
  chr7:27291314-27291851
  hyper
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtcc

SEQ ID NO: 669 - DNA, 476 bp, Homo sapiens
  chr7:30721202-30721678
  hyper
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcag

SEQ ID NO: 670 - DNA, 237 bp, Homo sapiens
  chr7:32467419-32467656
  hyper
gtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagc

SEQ ID NO: 671 - DNA, 69 bp, Homo sapiens
  chr7:32467946-32468015
  hyper
cgcctaacagtctggggtggatgggacttggggagtcgctatatagaggctgtccggaggctttactgg

SEQ ID NO: 672 - DNA, 266 bp, Homo sapiens
  chr7:33943692-33943958
  hyper
ttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcg

SEQ ID NO: 673 - DNA, 296 bp, Homo sapiens
  chr7:35293182-35293478
  hyper
cgttggcccgagaggagagttggggcttgggggacgccgtgaactccatggtccccagcacgcggtcctggccagggacggggtcgtccgaactgccgtccagattccccaagggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcacta

SEQ ID NO: 674 - DNA, 110 bp, Homo sapiens
  chr7:35294031-35294141
  hyper
cgcccgagatccgggcatggcccagttggggaagctatgaccagaccagtggaagcctcgggagttctcgctttttccattctttttcttacctgcgctcaaagttccaa

SEQ ID NO: 675 - DNA, 53 bp, Homo sapiens
  chr7:35296952-35297005
  hyper
cttaacgaatgctaacgaatgctcccttagctgggagctgcagggaccggtcc

SEQ ID NO: 676 - DNA, 217 bp, Homo sapiens
  chr7:35297137-35297354
  hyper
cgcttctcagcacaagggcatctgtctactcccgaacatggccggagattcctgtccacagcctccctccagctctttctggtagacactttaaaagcgacattaacgggcttcggtgcctttggattcctaaattaggtttacggaaaaggaaagacttcccaagaacagtgagaagaggaactgcagcccctccaaggccgctgcggcgcgttcc

SEQ ID NO: 677 - DNA, 547 bp, Homo sapiens
  chr7:35297470-35298017
  hyper
cgacgaacaccccgcgggttttagtttatcgagccaaagtggtcccggagaagcgctccctcgcagccaagctgcaagaagtggccgggaacctacaggcctcgggccgacccaggaagcctccgcaccagaaagctcgaggagcccttacccaagtcttgctcgaagggcaaagcaaagagccagcacccctgagtgtcactgaagttcctggatggggtgtgagtgcgcgcgttccgtccgagacctcagtctcgcccagctatagagccgataaagggatgtcttgtgggcgtaaggcgcttcgcgcccatctccaaggccgatgtggtcaggaggtgaggggaaatgtccttctggcagaagcccgcggtgctgcgacgttgacccgcctggcctcaggctcagggcggcgggcagcccagggcacatgtagtttcagcagccgcgctacgtgggcgggggaccccaggccaccccacgtgtccgccctgggcctcctccgggtcccaaggcgcggcgcctccaggccttgtagcgtcttccc

SEQ ID NO: 678 - DNA, 500 bp, Homo sapiens
  chr7:35301244-35301744
  hyper
ctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttccttt

SEQ ID NO: 679 - DNA, 147 bp, Homo sapiens
  chr7:37487113-37487260
  hyper
ggtcaaggcaggtcccgacccgcctccaacttcaaatggccccctaggcgggagagggtcactgggcggggagttcctggctgtgcggtcacacacacacacaccgactcacacacacacccacaacaccccccccacacacacaca

SEQ ID NO: 680 - DNA, 74 bp, Homo sapiens
  chr7:37487380-37487454
  hyper
accgacttcccaaccccaaacacacgcgcgcacccccgggacagctgagttctgtatttcctcttcctcaaagc

SEQ ID NO: 681 - DNA, 71 bp, Homo sapiens
  chr7:37487755-37487826
  hyper
gggggattccctcccatccccgagtgcaggagaagacgccgagtctgagccgcagccgcttctctagctct

SEQ ID NO: 682 - DNA, 268 bp, Homo sapiens
  chr7:38670396-38670664
  hyper
agccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccc

SEQ ID NO: 683 - DNA, 198 bp, Homo sapiens
  chr7:49812820-49813018
  hyper
tctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctg

SEQ ID NO: 684 - DNA, 197 bp, Homo sapiens
  chr7:49813809-49814006
  hyper
ggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctgga

SEQ ID NO: 685 - DNA, 134 bp, Homo sapiens
  chr7:49815116-49815250
  hyper
cgagcatcccgctggagaagctggcccaggcaccagagcagccgggccaggagaagcgtgagcacgcctctcgggacggcccggggcgggtgaacgagctcgggcgcccggcgagggacgagggcggcagcggc

SEQ ID NO: 686 - DNA, 109 bp, Homo sapiens
  chr7:49815656-49815765
  hyper
cgcagtgcaaggagaggaagaactactgcgagttccggggcaagacctatcagactttggaggagttcgtggtaagatgcgaacgcccgccgggcgactttgcaccttc

SEQ ID NO: 687 - DNA, 72 bp, Homo sapiens
  chr7:71802451-71802523
  hyper
gcagacacgcggggggcgagcaggcgcttggcagacggtgctccttccttcccttcccaaagaggctgccca

SEQ ID NO: 688 - DNA, 95 bp, Homo sapiens
  chr7:71802577-71802672
  hyper
cgccgccttcactacttcatcccaggtgcccacaccctagatccacgattacacctgagcccagggggaaggcggggcgccgaagtggaggggcc

SEQ ID NO: 689 - DNA, 644 bp, Homo sapiens
  chr7:79083190-79083834
  hyper
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaat

SEQ ID NO: 690 - DNA, 335 bp, Homo sapiens
  chr7:87229568-87229903
  hyper
taacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagc

SEQ ID NO: 691 - DNA, 96 bp, Homo sapiens
  chr7:96621715-96621811
  hyper
ctgtgattccaggagcgcgtgtgggcgcggtcctcgccgcgacgccgcgcgcgggtcaggctcaactgcgaaccttgccaccgagctttcccgcgg

SEQ ID NO: 692 - DNA, 340 bp, Homo sapiens
  chr7:96636033-96636373
  hyper
cgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttct

SEQ ID NO: 693 - DNA, 240 bp, Homo sapiens
  chr7:96653580-96653820
  hyper
ctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 694 - DNA, 131 bp, Homo sapiens
  chr7:96653862-96653993
  hyper
cggacgtctggaacggagcttggaagtcgccggatcggatgctggggacccttctgtcaaacactcctgtcatcgctcacgggcggcggcagcggctgtccttgctgttgtggcggcggcagctgccctag

SEQ ID NO: 695 - DNA, 223 bp, Homo sapiens
  chr7:98245856-98246079
  hyper
cgtgactttgtccctaactccgggtgtcccctccttcccatcagcgtccggcgcctggtcctggtcccggtccccgaggcccccgggattcttcccgagcgttttccgagttggcgcggggggtggaggcggggccatggagcgcgtcccggggaccgttgcatccggaggcggccgtcgtgcggctccttcccgcctcgagagtgaggtggccgggccttga

SEQ ID NO: 696 - DNA, 204 bp, Homo sapiens
  chr7:98246304-98246508
  hyper
cgaggggcgcctgggcacggccagccgaggctctcgagagccccagtgtcgttttccacctcaggcctcctttcctgaggcagagcccgggacctcgcgctctcgcctcaggctccggcccacgctcccgcccggccgccaggcgcgcaacggaaagcgcccccgccccgccccgctccgcccactgcgtgacgcgcacccggc

SEQ ID NO: 697 - DNA, 1085 bp, Homo sapiens
  chr7:98246533-98247618
  hyper
cgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgagg

SEQ ID NO: 698 - DNA, 302 bp, Homo sapiens
  chr7:108097189-108097491
  hyper
agggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatc

SEQ ID NO: 699 - DNA, 503 bp, Homo sapiens
  chr7:116962644-116963147
  hyper
gaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 700 - DNA, 68 bp, Homo sapiens
  chr7:116963330-116963398
  hyper
cgtccgctctgctcccctccgggcgcagccgagggagggggtgctgcgcctggcgggggtggggagaa

SEQ ID NO: 701 - DNA, 392 bp, Homo sapiens
  chr7:117119505-117119897
  hyper
aacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggaga

SEQ ID NO: 702 - DNA, 254 bp, Homo sapiens
  chr7:121939991-121940245
  hyper
agattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctc

SEQ ID NO: 703 - DNA, 25 bp, Homo sapiens
  chr7:121940433-121940458
  hyper
cggtgtggaccgatggtggattctc

SEQ ID NO: 704 - DNA, 306 bp, Homo sapiens
  chr7:121941881-121942187
  hyper
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgc

SEQ ID NO: 705 - DNA, 15 bp, Homo sapiens
  chr7:121943974-121943989
  hyper
ccgggtggcatgggc

SEQ ID NO: 706 - DNA, 123 bp, Homo sapiens
  chr7:121944176-121944299
  hyper
cgccgccggggcctccagactggccttccgcggctcggagcccgtcactcctgccttggggctcgtgtcgtaggccacaggcacgaaggggatcatgcaggggatcgacgagttgagatgcag

SEQ ID NO: 707 - DNA, 488 bp, Homo sapiens
  chr7:121946495-121946983
  hyper
aaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 708 - DNA, 64 bp, Homo sapiens
  chr7:121947097-121947161
  hyper
cgcttcgtagttgtccttggaccgggcgcagacactcagtattggtcagcgctggaaattttct

SEQ ID NO: 709 - DNA, 128 bp, Homo sapiens
  chr7:121950137-121950265
  hyper
acacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 710 - DNA, 125 bp, Homo sapiens
  chr7:121950428-121950553
  hyper
cgcagagccatttgaatagaagaagcccgaagtgaaacagaaaagctgaaaactccccggctgggctctccacttctcggttcttgctcacgagttccaaacagttaaagtgacgttggcaaggc

SEQ ID NO: 711 - DNA, 148 bp, Homo sapiens
  chr7:121951863-121952011
  hyper
ggctcctggaaacaacgcgaagctttaagcgccccgcgcgggtgttgacgctggcagctcgcaaacagcgtcccgcggccacggtgacccgaggggccggccggctgacgtcacgaacgcggccagctgcggggacccgggctgcaac

SEQ ID NO: 712 - DNA, 15 bp, Homo sapiens
  chr7:121952043-121952058
  hyper
cgagggtgggaaggg

SEQ ID NO: 713 - DNA, 124 bp, Homo sapiens
  chr7:121956458-121956582
  hyper
tccccatcttcaatccgaagctggggtatcccagagaaagtctcgctctgagctcctgctggggcacctgcccagccatgcccctcgagggcgtcgctgctctcaacccctctccgctactgcc

SEQ ID NO: 714 - DNA, 123 bp, Homo sapiens
  chr7:121956954-121957077
  hyper
cgcgaacatctctccggaacatcgatctatcacctccctttaaggacccggaccgggaaatttccattttctgttttgggaataagaaataaaagcgaccaagctcttgccctaatttccccc

SEQ ID NO: 715 - DNA, 153 bp, Homo sapiens
  chr7:127744057-127744210
  hyper
atgaagaaactgagccgaggaaaggaagcgacttggccaaggtcggagagctcattctttgcagggcggggtttggaacccggggtctggctctcggcaacgcgccctcggcccgcagcctcctgccccctgtgccccgcttcggcccccagc

SEQ ID NO: 716 - DNA, 459 bp, Homo sapiens
  chr7:127744211-127744670
  hyper
cagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctcc

SEQ ID NO: 717 - DNA, 100 bp, Homo sapiens
  chr7:128337422-128337522
  hyper
gccatgtaagcagagcggacaactctgagggcgtggctgggcggggttcttggggcagcccggcgccactgccggcatctacgcaccctgaacgcgcccg

SEQ ID NO: 718 - DNA, 13 bp, Homo sapiens
  chr7:128337582-128337595
  hyper
cgcctggaaatac

SEQ ID NO: 719 - DNA, 134 bp, Homo sapiens
  chr7:128337787-128337921
  hyper
cggaagctaagatgtggccgcatttaggaccccaccggcttggctgtgcctctcccagccccctggcggagcggactaaccctagcatttcattgattcacaataacgccaccccaccccgactgactattttg

SEQ ID NO: 720 - DNA, 8 bp, Homo sapiens
  chr7:129421701-129421709
  hyper
cccaggac

SEQ ID NO: 721 - DNA, 854 bp, Homo sapiens
  chr7:129422115-129422969
  hyper
ggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctgtgatctcgatctcgagggattcacttcacctctctaagcctcagtttcccatttgcaaaatgggcagaatgactcgcacctctggggatgaagaaaatgcacatgtgagcacgtgggtacttggcgacc

SEQ ID NO: 722 - DNA, 299 bp, Homo sapiens
  chr7:129423125-129423424
  hyper
cgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctcttta

SEQ ID NO: 723 - DNA, 1355 bp, Homo sapiens
  chr7:129424591-129425946
  hyper
caggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 724 - DNA, 627 bp, Homo sapiens
  chr7:137531262-137531889
  hyper
cgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtc

SEQ ID NO: 725 - DNA, 176 bp, Homo sapiens
  chr7:137531908-137532084
  hyper
cgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcattta

SEQ ID NO: 726 - DNA, 113 bp, Homo sapiens
  chr7:149112136-149112249
  hyper
gaacgcggatttacccggcatggtctttggaaatcagtgtgctgtggaagcaggtcttgctagagccaagaaacctctaaaagccactattcagggggcacccggatttgaac

SEQ ID NO: 727 - DNA, 2593 bp, Homo sapiens
  chr7:155164445-155167038
  hyper
ttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagc

SEQ ID NO: 728 - DNA, 51 bp, Homo sapiens
  chr7:155167039-155167090
  hyper
ggagcaggggcggcccggcgggcgggccgggacccggcttttccggctacc

SEQ ID NO: 729 - DNA, 487 bp, Homo sapiens
  chr7:155167174-155167661
  hyper
cgctggcgaggcgtttcttgtccccggcgcccgctcggtgccgtctcagtgagtttgattgaaacgcggctgcgggaaggggtcgacagaggcaagctgcgagcaaggcgggggtgggggcgaggaaggggacccggagagctcccggagggcttggccggccaccgccgcgcggcgctgctcggggactgctactttgcaaggcggcggctgcccctgcggggttcgggttgcagggtcaagtgtcacgtcctccgcaatctccaatattcctgtaatgtatttaaatggacgaattcattacgcggggccgtgtgaatggggcgaggccgcgagcgcggcgcgatcagtagcgcccactaacagttcgttctgcacggcggagcgcgagaccgcggacccacggaagccccctcaatggtgtttgcgtcctcgccgccaccggcttggtagggtcctttagggaaggaggaagagttcaggcacc

SEQ ID NO: 730 - DNA, 61 bp, Homo sapiens
  chr7:155241429-155241490
  hyper
ccgcccgggtggacccgccctgttcaagcgcggaggggcggaggcctggttgggttgtagc

SEQ ID NO: 731 - DNA, 738 bp, Homo sapiens
  chr7:155241491-155242229
  hyper
tggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcc

SEQ ID NO: 732 - DNA, 491 bp, Homo sapiens
  chr7:155246989-155247480
  hyper
ctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggct

SEQ ID NO: 733 - DNA, 423 bp, Homo sapiens
  chr7:155254901-155255324
  hyper
agcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggc

SEQ ID NO: 734 - DNA, 792 bp, Homo sapiens
  chr7:155258072-155258864
  hyper
tttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 735 - DNA, 164 bp, Homo sapiens
  chr7:155258914-155259078
  hyper
cgctggttcctctcgggcctcccgggctctgcgtgccgcggatctggacccggactgcagacaccgccccacgactgggcccccggccagactgttaccccacaggaggagggttccctaagtgtgcagaagaggaaagctcatttataaagtccttgctcctt

SEQ ID NO: 736 - DNA, 504 bp, Homo sapiens
  chr7:155259119-155259623
  hyper
cgccgggcccaggctgagcttactccacactgctccatagccgggcagagactccgcgagggtctgggagtcctggcctcggaggacccgccgccctgcaggcctgcccaagcaggcgcccccgcgagagtgcgggacagagagggcctggcggggctccttggcgctgagagccctccttctccgctgcacccagctctgccaacggggctggatgagtgggggctggagtcagaatcccagggtctacacccgccgacagcagcaatgccgacccgccctgcctttctcctaaggagcggagggaaggagccatgtgaatgaccccagcctgaccaccaagagggcgccagcatttctgttttcctagagtgaaaaggtcaaatcgatgggggctcctacaccgctggacacaggtgcgcccgggcgtccagtgcgcgcaacacacgcccagacactctatatgcaaatatgcctgccgccgcggagccggccgggaggcag

SEQ ID NO: 737 - DNA, 12 bp, Homo sapiens
  chr7:155259833-155259845
  hyper
cggggattcgcc

SEQ ID NO: 738 - DNA, 112 bp, Homo sapiens
  chr7:155259846-155259958
  hyper
ggtgaggcagaaatcagcctccggggagatgggtccccccttcccgacgcgcccctgcacacactgctgccccggcgccgggcctccgggcggggacccctcttccgggcat

SEQ ID NO: 739 - DNA, 99 bp, Homo sapiens
  chr7:155260038-155260137
  hyper
cgccggcgggacggagagtggggtcccccggaccctgggtcgggcaggcctggcgctggcagctctgttgcacagatttgtgagcgatgctggtggccg

SEQ ID NO: 740 - DNA, 197 bp, Homo sapiens
  chr7:155301753-155301950
  hyper
aagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttatta

SEQ ID NO: 741 - DNA, 346 bp, Homo sapiens
  chr7:155302372-155302718
  hyper
ccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggc

SEQ ID NO: 742 - DNA, 188 bp, Homo sapiens
  chr7:155302963-155303151
  hyper
cggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatc

SEQ ID NO: 743 - DNA, 21 bp, Homo sapiens
  chr7:156794464-156794485
  hyper
ccactgcgcccagcctgattt

SEQ ID NO: 744 - DNA, 288 bp, Homo sapiens
  chr7:156795067-156795355
  hyper
ctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 745 - DNA, 235 bp, Homo sapiens
  chr7:156795401-156795636
  hyper
cgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccc

SEQ ID NO: 746 - DNA, 114 bp, Homo sapiens
  chr7:156795899-156796013
  hyper
cggcctgctggaggcgcaggggccggcgcaggtccggggcctggctctgctggaggacgggggaggggcggccctattaacagcgtcttcctttgatgtcgctcttccccgcgt

SEQ ID NO: 747 - DNA, 246 bp, Homo sapiens
  chr7:156796494-156796740
  hyper
tttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggag

SEQ ID NO: 748 - DNA, 355 bp, Homo sapiens
  chr7:156797005-156797360
  hyper
cggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggcc

SEQ ID NO: 749 - DNA, 828 bp, Homo sapiens
  chr7:156797607-156798435
  hyper
aatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcc

SEQ ID NO: 750 - DNA, 621 bp, Homo sapiens
  chr7:156798526-156799147
  hyper
cgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatg

SEQ ID NO: 751 - DNA, 50 bp, Homo sapiens
  chr7:156799290-156799340
  hyper
cgcggccggcggcacttccccaggaggttcgactgcgcctgggctgggga

SEQ ID NO: 752 - DNA, 434 bp, Homo sapiens
  chr7:156801438-156801872
  hyper
ccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 753 - DNA, 31 bp, Homo sapiens
  chr7:156810491-156810522
  hyper
gggcccctggtgacccgccccggcttcccct

SEQ ID NO: 754 - DNA, 204 bp, Homo sapiens
  chr7:156810597-156810801
  hyper
cgcgaacccggtgactctgggccccttacattaaaataattacccggcggaacaggtggcccactcccggcgcctgggtgcatctgggcccccggagccgcagcccgggaggaggggagcggcacgcccaggggagggaaggtcaggcccgctgagccgggagccgggagggtagagaggggctttcctagggacagacggtcc

SEQ ID NO: 755 - DNA, 104 bp, Homo sapiens
  chr7:156811302-156811406
  hyper
cgacattctgtaaatgagataatgatccataaacccggatgatagatgtggcgtgcctgcgatgtcttctctaaatgagctgctcgcatcgactgctaataatg

SEQ ID NO: 756 - DNA, 974 bp, Homo sapiens
  chr7:156812852-156813826
  hyper
gttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacc

SEQ ID NO: 757 - DNA, 244 bp, Homo sapiens
  chr7:156813986-156814230
  hyper
cggcgcggacacccgggctgcgctcagcccccacccccacaggcttcccagccgtctgcccgagttcggcttcaacgggagcggggctccacttttccttaattgacgaagtcacggattcctcccgggcggatttatggggctgcgcgttgtgccggcgcccgctgcttcgcatctgcgcgcccgcccggtgccgggccccgccctccgcctcagccccaagctcggcccgcgggcccggcca

SEQ ID NO: 758 - DNA, 16 bp, Homo sapiens
  chr7:157477473-157477489
  hyper
gggccggggtctcctc

SEQ ID NO: 759 - DNA, 107 bp, Homo sapiens
  chr7:157477710-157477817
  hyper
ggagccatacctgggcgggagggcttttcccgggggcccggcctgcgcccctcgccgcccctcgcccctcgcctctcgcctcccgcgggtcccgcctggccttggcc

SEQ ID NO: 760 - DNA, 50 bp, Homo sapiens
  chr8:23559552-23559602
  hyper
ggaggatggtaggcccgctagatcaccatctccattcaccgccgatgccc

SEQ ID NO: 761 - DNA, 972 bp, Homo sapiens
  chr8:23559665-23560637
  hyper
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggc

SEQ ID NO: 762 - DNA, 230 bp, Homo sapiens
  chr8:23564830-23565060
  hyper
tctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagc

SEQ ID NO: 763 - DNA, 292 bp, Homo sapiens
  chr8:23571681-23571973
  hyper
ctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctggga

SEQ ID NO: 764 - DNA, 514 bp, Homo sapiens
  chr8:24858647-24859161
  hyper
gctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggag

SEQ ID NO: 765 - DNA, 193 bp, Homo sapiens
  chr8:37655798-37655991
  hyper
ttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagc

SEQ ID NO: 766 - DNA, 148 bp, Homo sapiens
  chr8:37656049-37656197
  hyper
cgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgca

SEQ ID NO: 767 - DNA, 415 bp, Homo sapiens
  chr8:37822994-37823409
  hyper
cagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 768 - DNA, 13 bp, Homo sapiens
  chr8:37823410-37823423
  hyper
ggttggagtggca

SEQ ID NO: 769 - DNA, 389 bp, Homo sapiens
  chr8:38008209-38008598
  hyper
ggcctgagcctcatccgctgagagctggccaacccctcatcgcctccttcccgcagcgctcacccttcatgttgcgcatgtgtctgtaggagctcccagcgcacagcttgaatgtcgctagcagcattgtttcctggcaaatgtggcagtggtggggtcgctgccgctgctgctgccgccgctgctgctgcctcttctctcaagggtggttcttcgtccttcctgagcccctcaagcttcgcctctgagtcccgcagctgcagcctggacctggtgttctgcgtcttaaatgtcccccgctgaaggctgtgcatcatcatcaggagataaaaacgccatcactcactgtgcaaaggaaggggtcaaggatagagcgattgcctcacact

SEQ ID NO: 770 - DNA, 160 bp, Homo sapiens
  chr8:49468668-49468828
  hyper
ttaggaacatttccccggtcggtcattagcgcgcgctctccccgcgcccagggtgcccccgtgcccagggtgcccccgcccggcgcctccgcggtcccctcccgcgcgcacctttccgagtgccagtggggcggccccgagaccgcaattgctctggccc

SEQ ID NO: 771 - DNA, 362 bp, Homo sapiens
  chr8:49468829-49469191
  hyper
gattgacgagcctccgatgcccatttactgcgcgcggcagccactctggagccgcggcacatctggatggagtcagctgcctagcgccaggggccagcacggcccagccagcggagcgcggcggtgagcgctagggaggccggcgcccgggccgcctccgcggccgaccccctgtccccacccgagcaggatttcctgatgtaaacacagcggctctgcgagaacagagctgctctcctgaatgtgtcatttagtgttctttatctgcttggggtcagcatagcgacttagaaaaacagcagtcttgctttgaatttaaacagcgaagaagccagagggtcctgttccgtatggggggaggg

SEQ ID NO: 772 - DNA, 193 bp, Homo sapiens
  chr8:54789613-54789806
  hyper
aacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 773 - DNA, 588 bp, Homo sapiens
  chr8:54790022-54790610
  hyper
ggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaac

SEQ ID NO: 774 - DNA, 49 bp, Homo sapiens
  chr8:54791897-54791946
  hyper
cgcaaggttcttctctcaccttctccggcgaccccctcccgaggctccc

SEQ ID NO: 775 - DNA, 487 bp, Homo sapiens
  chr8:54792184-54792671
  hyper
cgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcc

SEQ ID NO: 776 - DNA, 427 bp, Homo sapiens
  chr8:54792701-54793128
  hyper
cggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattca

SEQ ID NO: 777 - DNA, 223 bp, Homo sapiens
  chr8:55370113-55370336
  hyper
ccactgaaacaccctcggcttctgcaaaaagatgtgctttaaagagaatagaatggacgctcggtatgttcatctaaacgaccttgggcaagtacgtcgattccaaggtacaatcagccctcccagacggcttttcgagtctccctaaccccggtgggagaggacgcggcgccagagcccagctccggctagttttcccgggggcaggtgtagccttgggcgc

SEQ ID NO: 778 - DNA, 86 bp, Homo sapiens
  chr8:55370337-55370423
  hyper
gggccgggggaggggcaaggggcgggcgtggggttggactgggacgtgggactcggaccacggcctgggcgtgggcctaacgacgc

SEQ ID NO: 779 - DNA, 9 bp, Homo sapiens
  chr8:55370424-55370433
  hyper
ggaccggcc

SEQ ID NO: 780 - DNA, 109 bp, Homo sapiens
  chr8:55370567-55370676
  hyper
cggcttcgggccgggagacccgcgcagccctcggggcatctcagtgcctcactccccaccccctcccccgggtcgggggaggcggcgcgtccggcggagggttgagggg

SEQ ID NO: 781 - DNA, 204 bp, Homo sapiens
  chr8:55371172-55371376
  hyper
cgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgac

SEQ ID NO: 782 - DNA, 286 bp, Homo sapiens
  chr8:55371439-55371725
  hyper
cgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggc

SEQ ID NO: 783 - DNA, 75 bp, Homo sapiens
  chr8:55371993-55372068
  hyper
cggcgtggaccccgacccggctttcttcgccgccccgatgcccggggactgcccggcggccggcacctacagcta

SEQ ID NO: 784 - DNA, 60 bp, Homo sapiens
  chr8:55372416-55372476
  hyper
cgtgtgcaagcctgagatgggcctcccctaccaggggcatgactccggtgtgaatctccc

SEQ ID NO: 785 - DNA, 19 bp, Homo sapiens
  chr8:56015034-56015053
  hyper
ggtgtggaggcatcatggc

SEQ ID NO: 786 - DNA, 161 bp, Homo sapiens
  chr8:56015185-56015346
  hyper
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcc

SEQ ID NO: 787 - DNA, 67 bp, Homo sapiens
  chr8:56015565-56015632
  hyper
ccgaggacagcgccacggccgctgctgcctccagctgcccgcagcctggagccgattgcaagacggt

SEQ ID NO: 788 - DNA, 148 bp, Homo sapiens
  chr8:57069590-57069738
  hyper
gcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtc

SEQ ID NO: 789 - DNA, 163 bp, Homo sapiens
  chr8:57069850-57070013
  hyper
cgcgggagaaggctggtgggtacaggttgcctccgggccggagcgcccatgcagggcgagctgcgctccgcacaaaattgcggtgggggcgccagaccgccttgctccgcccctgagcggggcgccccggcccaaccccctgagggaggagggtccaggtgcc

SEQ ID NO: 790 - DNA, 143 bp, Homo sapiens
  chr8:57070014-57070157
  hyper
cagactcttagcccctggcccggcgtccgcccggcaggttctggcactcctcgttggtaagccccgttatttcgtgcgcagtgtttacagaatataaagttcttcaggaaacgatgttataggagaaacgcctggattttccc

SEQ ID NO: 791 - DNA, 286 bp, Homo sapiens
  chr8:57358806-57359092
  hyper
gccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggcaagtgtgaggagggcgggcgtcggggagaag

SEQ ID NO: 792 - DNA, 400 bp, Homo sapiens
  chr8:57359259-57359659
  hyper
cgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggc

SEQ ID NO: 793 - DNA, 86 bp, Homo sapiens
  chr8:57360540-57360626
  hyper
tttccaggccctctgcgccctctgcaaagggctgatttctacagtcgctaggacctgcagcggcgctgctcccgcggggctccggc

SEQ ID NO: 794 - DNA, 37 bp, Homo sapiens
  chr8:57360769-57360806
  hyper
cgagcaccgcctgcctcccggccggggcatcacggta

SEQ ID NO: 795 - DNA, 95 bp, Homo sapiens
  chr8:67873327-67873422
  hyper
ggcacaaaaatccttcggaggcatcctgtaagaggcttgcgagactcttaccaagccaccccggctttaaacgcctctccagccacctgtgaacc

SEQ ID NO: 796 - DNA, 1 bp, Homo sapiens
  chr8:67873798-67873799
  hyper
c

SEQ ID NO: 797 - DNA, 251 bp, Homo sapiens
  chr8:67873800-67874051
  hyper
tgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggc

SEQ ID NO: 798 - DNA, 509 bp, Homo sapiens
  chr8:67874164-67874673
  hyper
cgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggc

SEQ ID NO: 799 - DNA, 103 bp, Homo sapiens
  chr8:67874755-67874858
  hyper
cgaccggctaaggcaggtcgggcggaggacctggcccaccggagaggctacgccgggggctgaggcggcttagagggtcattaatcaaaccctccggcggggc

SEQ ID NO: 800 - DNA, 402 bp, Homo sapiens
  chr8:67874859-67875261
  hyper
ggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagacccc

SEQ ID NO: 801 - DNA, 179 bp, Homo sapiens
  chr8:67875262-67875441
  hyper
aatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcac

SEQ ID NO: 802 - DNA, 240 bp, Homo sapiens
  chr8:67875442-67875682
  hyper
ggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacatttt

SEQ ID NO: 803 - DNA, 23 bp, Homo sapiens
  chr8:70982262-70982285
  hyper
cgctcccacaattaagacaaaac

SEQ ID NO: 804 - DNA, 281 bp, Homo sapiens
  chr8:70982286-70982567
  hyper
aaaaaacagcaatagaagcaaacacaaaaaagccccaaacggaaatctgccgggatcctgccctactctaaattccgggttagtgttgccttccccttccctctccaagcaccccttccctaagcccggccgccttcccacacccgctctccgctttcggcccccaacccggttcctgcaaaacccattgaagttccctttccttccttcttctcagtcctacaaaactcgttggtagggtctgtgggagccgcggggccctgccaacctcggggctgggc

SEQ ID NO: 805 - DNA, 397 bp, Homo sapiens
  chr8:70982850-70983247
  hyper
cgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatct

SEQ ID NO: 806 - DNA, 302 bp, Homo sapiens
  chr8:70983568-70983870
  hyper
gcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggt

SEQ ID NO: 807 - DNA, 277 bp, Homo sapiens
  chr8:70984016-70984293
  hyper
cgagtccccggcagtgacacgtgggagcgttgggcccggcacccccgacgcttccgaggtttcgggtggtcgttttgctctctcgggggcttttattccttaagtggctttaaacgaccgaggatgggcctcccgcgccgccgcagctgtcacttccttcgggaaaggctagcgaccttggacgcgcaggctctgaaaaccaaggtccagacccataccgagcgcccaaagaccgcatttgaattctcctcgccggccattgagggagagaaaggaa

SEQ ID NO: 808 - DNA, 319 bp, Homo sapiens
  chr8:70984343-70984662
  hyper
cgcagtcttgccgggtgagccgggacaggttcctcgcctgccccccggccgctgcttcctcttagctgaatggggagcgacccgccccgggcgcggccttcggggctgaagactgaggtgcagcctcacccccggcctggcagcggcttggaagagagagggaaaggaggaacatctacccggctaagagacgccgccagagtccctaaagctggcgggggacggaggccggggtcccggatcttcagagcgcccgcagccgggcttctgggctcctcggtgcggggaacctgaccctgtagccttcgccagggcgcgg

SEQ ID NO: 809 - DNA, 250 bp, Homo sapiens
  chr8:70984744-70984994
  hyper
cgccctgccgcctgcttgccccctttgctgcaccgggtggccctggtccccgcgcccgcccgcccccgacgccttcgcgtggttccgcgctgcccgcggccagccccgtttcgcttcgcaaggagcgtgttgttttctcaatcgaaatgggatcaagatcccagggtttcctcgtctccttgttttgaggtgataggatcttagccaatagatcgaaaacgtgaaaagtacccgtcgcctcttgtcccaa

SEQ ID NO: 810 - DNA, 78 bp, Homo sapiens
  chr8:72460433-72460511
  hyper
cgcccctccgctctgcagccggagcctgggcctggtgcccactgccccgcggggtgtctcggacgcctggcccctgca

SEQ ID NO: 811 - DNA, 345 bp, Homo sapiens
  chr8:72755470-72755815
  hyper
ctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 812 - DNA, 157 bp, Homo sapiens
  chr8:72756655-72756812
  hyper
cggtaagctgcgccttttgaaaaggctatctgtactccttggaacaaaccaccccgggcaaagaagagggggttgtaaagggggccaagaggtggggcaggggcgtggaaggggtggggaccgcttttctgcatgccgaagagcggttggtggaggc

SEQ ID NO: 813 - DNA, 83 bp, Homo sapiens
  chr8:72756813-72756896
  hyper
ggggaaggggacgtctctgcagagccgagatttgggctctgaagcccgacggcccttcaacatgtctgcgcaggataagtgag

SEQ ID NO: 814 - DNA, 448 bp, Homo sapiens
  chr8:91997061-91997509
  hyper
cgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 815 - DNA, 479 bp, Homo sapiens
  chr8:91997527-91998006
  hyper
cgaggggcacgaggcgggcccagggcgggcgcggggcgtggcctcgggcgctgagcctcgagagcagccgcacccctgccggggtagaaccgttaaaagggtggcgcgcgctttcccgggcgagctgggcgcgtggggttggagcggcgccacccagagccggtcgtctagggtaggaggccgcgagtgaggcgctgacaggctagccctcgacggggcgcgcccgcgtgaacggccttgggggccccagaccgtggccctgcttgtgcgaagactgggaggcgccaggcgggccgcctgctgggggcttggcggcgggttccaggcagcgtctgtgagggaggccgcctctgtgagggaggccgccgtcgtgctgacgactgagtccaccctactcctgtcccccgtcagagctgctggcaggcgctgctttccccttggtgcatttagtgggtgtcgggattcgggttggcagggag

SEQ ID NO: 816 - DNA, 202 bp, Homo sapiens
  chr8:97157008-97157210
  hyper
cgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 817 - DNA, 232 bp, Homo sapiens
  chr8:97157666-97157898
  hyper
cgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccc

SEQ ID NO: 818 - DNA, 122 bp, Homo sapiens
  chr8:97158021-97158143
  hyper
ggcctaccgggttttccccccaaaaggcttcgtaaccactaatgtgccctttgtggtctcaagcctgggccgcgtttcccctagacctcctctgggctgggctggctcgttctcgttgacgt

SEQ ID NO: 819 - DNA, 204 bp, Homo sapiens
  chr8:97169716-97169920
  hyper
cccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggc

SEQ ID NO: 820 - DNA, 13 bp, Homo sapiens
  chr8:97169921-97169934
  hyper
gaagtccttgcca

SEQ ID NO: 821 - DNA, 180 bp, Homo sapiens
  chr8:97170158-97170338
  hyper
ggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtc

SEQ ID NO: 822 - DNA, 291 bp, Homo sapiens
  chr8:97170377-97170668
  hyper
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccga

SEQ ID NO: 823 - DNA, 361 bp, Homo sapiens
  chr8:97171598-97171959
  hyper
cacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 824 - DNA, 722 bp, Homo sapiens
  chr8:97172018-97172740
  hyper
cgcggactagttcctcagactgtgggactccctagtgccggctttgcccagggctttccaaggctgtctcatgccctagatctgccccagcagctcaggccttggactgcgaacccagtatcccgagacaccgattccatcagtccccatcccgacccctctccagccgggttcatccgcctgctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcacaaatgtagcctccagcgggaacagctccctggctgccgagctccagcgggaggggagtcgagcgttttctttgccacttacctagtcccctgtctacaaagctggtgatcgtattagccgacttggaagactggaaaaagctggcattgatgcccagcttctcagcgatggagtaagtcctgtagattgacagcatgtactcgtggggcaccacgcgcggacccctgcctggcggctcctgcgcccggggctgctgagcccggggttcgtcctgaggccgcggctgtggttcctggccctcccggcc

SEQ ID NO: 825 - DNA, 50 bp, Homo sapiens
  chr8:97172821-97172871
  hyper
cgacgaggaggatgagatggaagcctgctggaaaccgggcaaatcccaca

SEQ ID NO: 826 - DNA, 388 bp, Homo sapiens
  chr8:97173138-97173526
  hyper
gggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggc

SEQ ID NO: 827 - DNA, 13 bp, Homo sapiens
  chr8:97173527-97173540
  hyper
gtggtaccctccc

SEQ ID NO: 828 - DNA, 50 bp, Homo sapiens
  chr8:98289818-98289868
  hyper
cagtccagggggagccggcaggcggcctcctccccgagccggaggagctg

SEQ ID NO: 829 - DNA, 425 bp, Homo sapiens
  chr8:98289922-98290347
  hyper
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccat

SEQ ID NO: 830 - DNA, 660 bp, Homo sapiens
  chr8:99439694-99440354
  hyper
ggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgc

SEQ ID NO: 831 - DNA, 298 bp, Homo sapiens
  chr8:99951846-99952144
  hyper
actgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 832 - DNA, 106 bp, Homo sapiens
  chr8:99952198-99952304
  hyper
cgaaaagcaccatgaattcgaagcagccttggacgcgggatcatgggcgttagcctggctctctccgacgaggcaaactgcaggagatccccttccctggagtcac

SEQ ID NO: 833 - DNA, 319 bp, Homo sapiens
  chr8:99952532-99952851
  hyper
gccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggag

SEQ ID NO: 834 - DNA, 178 bp, Homo sapiens
  chr8:99985866-99986044
  hyper
catgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgc

SEQ ID NO: 835 - DNA, 302 bp, Homo sapiens
  chr8:99986225-99986527
  hyper
gggagttgcttctccagtcggtgaacgctccgttgagccacgtctatgcgcttgctcatggataagcgcactgggggactatactgcagtgtgaccgccagtgtccccagggaggctgcggaaaagtagaggcaatgagacccgagcagaaatagggacttctcgcggcagtccgcacggaagcagctggggagcatccagctcgaccctccccacaggcccagggtcgggacaccgagggaaggcgcggcgcgcgcggcaaggccaggggcgcggggctgggctcggccggcacaagtgct

SEQ ID NO: 836 - DNA, 165 bp, Homo sapiens
  chr8:99986791-99986956
  hyper
cgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttg

SEQ ID NO: 837 - DNA, 408 bp, Homo sapiens
  chr8:114444784-114445192
  hyper
ttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagcc

SEQ ID NO: 838 - DNA, 777 bp, Homo sapiens
  chr8:132053807-132054584
  hyper
gagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 839 - DNA, 164 bp, Homo sapiens
  chr8:132054593-132054757
  hyper
cgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatga

SEQ ID NO: 840 - DNA, 293 bp, Homo sapiens
  chr8:140714570-140714863
  hyper
taaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgac

SEQ ID NO: 841 - DNA, 84 bp, Homo sapiens
  chr9:117876-117960
  hyper
ctctgaggggtcgctcgggccgccgccgccctcgatgtgctctcggggaagcgcaaccccgccccaccgggccacctgcagccc

SEQ ID NO: 842 - DNA, 30 bp, Homo sapiens
  chr9:970195-970225
  hyper
gacctgcgctggccacgcagggtctcaagc

SEQ ID NO: 843 - DNA, 414 bp, Homo sapiens
  chr9:972345-972759
  hyper
cagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccaggg

SEQ ID NO: 844 - DNA, 274 bp, Homo sapiens
  chr9:1052044-1052318
  hyper
gcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 845 - DNA, 268 bp, Homo sapiens
  chr9:6645065-6645333
  hyper
agaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaa

SEQ ID NO: 846 - DNA, 153 bp, Homo sapiens
  chr9:19789107-19789260
  hyper
gctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagag

SEQ ID NO: 847 - DNA, 93 bp, Homo sapiens
  chr9:29214993-29215086
  hyper
tcacagctctgaaatcgatccagagcattccacagtgagcgttgcggctcccaggggctccggaccggtaacttcaggcgcaagtctgaattt

SEQ ID NO: 848 - DNA, 874 bp, Homo sapiens
  chr9:37029893-37030767
  hyper
gtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcac

SEQ ID NO: 849 - DNA, 812 bp, Homo sapiens
  chr9:37037453-37038265
  hyper
gggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcac

SEQ ID NO: 850 - DNA, 522 bp, Homo sapiens
  chr9:79626876-79627398
  hyper
catttctagaagtgccgctaccccaggaaactcacatctctccacctccatcgctgtgcggagaaaacccgcaccgaaggcggcttcctctctaaggcggcgaccaggggagacagcgccccctgctgactaaaatcacgcaggcctcgttgccaaagtgcagcgggcgcagcgggcgcagcggtctcccggcttccctcccggcgcccgcagcctgcctaaagcctttctggaaactcgtgttttcagcctcagcctggcagactgcggagggcgggccaggaagagtcaaggagccgggggtctcagactttgctcaccccttggaaatcaccttctcgacccgctagcctaggccgagacacagtctgtattctgaaagccgccagtcccaccaggggaggagaaacccaaaacagaaggagcagggccccacggctgggctcgtgacgaagcatttaatgacctttttaaggaaacgagggaggaggtgaggaggccaacagccgcttaggagagccc

SEQ ID NO: 851 - DNA, 199 bp, Homo sapiens
  chr9:79629207-79629406
  hyper
cggctcagacaacccagccagtctcgcccgcgagcggaggtgctagaaactttgggggacgaaagctgggctgtctttcttggccggtggcactgcgagagaaagccgtgtgcaccccgcggctgaccactccaacgccagatacatccacccgctcatgtaccgccgtcgggcttcattttgtcgagctcttcttagg

SEQ ID NO: 852 - DNA, 131 bp, Homo sapiens
  chr9:79635834-79635965
  hyper
gcggctccttgcactcggtgctagtgcactcctaggggacccggcgggcgtggggagaccagcggggtgagagacgccgggcccggaaccgcccaaaccacccgacggggagagggcgccctggtcaggcc

SEQ ID NO: 853 - DNA, 295 bp, Homo sapiens
  chr9:79636258-79636553
  hyper
cagagctaaacctcccgcgaagaatccaacagagagtgacgctgaaacggatctcagccaccacgtttctctctgctggtcgcatcctcggcggtcgcctctcgtgaacattcaagacaaaactgccgtccactaaggaaatttcgttttatttaagaaggaaaagaggaagcgtttgataccgttattttcctagtcagctaaatgggcaaggaaacggtgtcatgaataaagtcgctttggagggggaaggggaggagaggaggcagcgggaaccccacgaaatatctttggg

SEQ ID NO: 854 - DNA, 230 bp, Homo sapiens
  chr9:79637659-79637889
  hyper
tttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 855 - DNA, 46 bp, Homo sapiens
  chr9:79638136-79638182
  hyper
gctggggcctgggaagccgcgtcccggcctccgccctccacccttt

SEQ ID NO: 856 - DNA, 8 bp, Homo sapiens
  chr9:96720878-96720886
  hyper
gaaaatcc

SEQ ID NO: 857 - DNA, 366 bp, Homo sapiens
  chr9:96721102-96721468
  hyper
gggacagggaggggaccacctcattcccacaaccgaatcccctaagcattcaggtgtaggttccagaaccacctcccctccacccacacccttctcctactccagcgcctcccagacgggattgtgaaatggctccgcgtgcgaacgggtccaggagccgttcgttgtacagaggaggaagctaagtctggaaggagcactcgagcaggctcagcggccagcagccagcggcagggggatcgtgcatcgcttggagggcgctgggctctcctccatccgcctcagccgtgggcagtttgtttccgctcccacttgcagcgggtctgcatcttaattggcaaaacgaagttggggccgcggtggagc

SEQ ID NO: 858 - DNA, 114 bp, Homo sapiens
  chr9:96721688-96721802
  hyper
gggaatggagctcgtttcctcttttcttttttcttcttcttcttttttttttttaaacctttggttctgattgtccttggcccagcaggctgttggtggcgttggtggtgctgc

SEQ ID NO: 859 - DNA, 212 bp, Homo sapiens
  chr9:98111349-98111561
  hyper
ctaccaggacacatgcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcc

SEQ ID NO: 860 - DNA, 264 bp, Homo sapiens
  chr9:98111894-98112158
  hyper
cgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcc

SEQ ID NO: 861 - DNA, 52 bp, Homo sapiens
  chr9:98112343-98112395
  hyper
cgcgccccggctcccagcgccctgtttttggaaaatacgattttgtagggtg

SEQ ID NO: 862 - DNA, 432 bp, Homo sapiens
  chr9:99639601-99640033
  hyper
aacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctc

SEQ ID NO: 863 - DNA, 92 bp, Homo sapiens
  chr9:100610725-100610817
  hyper
atcctggactctagacgttgcctgggggccgatcctgcgcccagggtcccagaatctaactgaaatgcgcctgcgggccgccaccttcgccc

SEQ ID NO: 864 - DNA, 516 bp, Homo sapiens
  chr9:100611124-100611640
  hyper
gggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatca

SEQ ID NO: 865 - DNA, 108 bp, Homo sapiens
  chr9:127212898-127213006
  hyper
ttcgcatctccctctcgggcctcaacgagtgtttggagagcaagaaaagtgggcgccagggggcttgagggcgcgaatccaggcagacgtgaacgagggagtgctttt

SEQ ID NO: 866 - DNA, 742 bp, Homo sapiens
  chr9:133541665-133542407
  hyper
attcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccc

SEQ ID NO: 867 - DNA, 275 bp, Homo sapiens
  chr9:135462647-135462922
  hyper
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacct

SEQ ID NO: 868 - DNA, 545 bp, Homo sapiens
  chr9:140772756-140773301
  hyper
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcgg

SEQ ID NO: 869 - DNA, 121 bp, Homo sapiens
  chr10:7450069-7450190
  hyper
gcttgtcagcggcgacgtcaggaggacaaggggaggggttcgcggctgaaactgcagcttcgcagcacagagccattttaggctgctccccacctcgcggggcccatgggaaagccggccc

SEQ ID NO: 870 - DNA, 1772 bp, Homo sapiens
  chr10:7450490-7452262
  hyper
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacga

SEQ ID NO: 871 - DNA, 376 bp, Homo sapiens
  chr10:8085599-8085975
  hyper
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtgg

SEQ ID NO: 872 - DNA, 858 bp, Homo sapiens
  chr10:15760996-15761854
  hyper
cgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 873 - DNA, 111 bp, Homo sapiens
  chr10:15761855-15761966
  hyper
gtccccagctgcccgtgtcccgggtcggtgcgctcggcgcacccgtggtgacagtgcccggcgtctgctcccacccgcccgcccgcccagccggctcggggggctggccca

SEQ ID NO: 874 - DNA, 615 bp, Homo sapiens
  chr10:22541236-22541851
  hyper
ctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 875 - DNA, 226 bp, Homo sapiens
  chr10:22542024-22542250
  hyper
gaatccccacctcggtcctcgggtagaggcgcaagcgcgccccaagaccattctcttcgcgcccacccccgttattcttcactttcacttgacatcgttcttcactcaaggttaggtcctcgctagtgccagagaagcccctgggtccccagtgccctcagccccgcagcgtagggagcagccggcccgggagataaggaggccacagccatggaggccccaggcc

SEQ ID NO: 876 - DNA, 560 bp, Homo sapiens
  chr10:22624561-22625121
  hyper
cggcgctccgggtggacggctccggggcgcggctcgtccctcgggtggtgcagcccccgcggcccgagacccggggagggccgggggtactttctgcgaggcgccttccccgcggcttctgcccgcgccaaagcctggtggaatccagcgcagacctaaagcacgcttgacaccccgatttttcgagactaggacgactctctgagccagcagctttcctctccctctcggggagaatctcatttccttggggtggtgagggtgacgggcactgtcttttggccccgcgtgtccgttccccggtctcccgcctcacccctctgcgaggtgaggaggggaaacggcgagcttaggcctggcgggaaggagcctacccgacgagagggctccgcggggagggtcggttggaatcccgccctagcgcctcctgctctgcccggtccccaccggggacggggaatgccagtcatttctgttgagtgctagcagggccggtgtcaccacctcgggtggccgaggcttcgaggttttcatgaaaagcccccgaagcgtgaggcgcc

SEQ ID NO: 877 - DNA, 401 bp, Homo sapiens
  chr10:22625382-22625783
  hyper
cgtctttgccgcacagctgcagtcaaggcccggagggactgcgggacgcgggcgggagcgagagccctgtgggctgccaagccggcgcggccgcgccgcggcagccgcttcccttgccaccttcgttccaggggctgcggggctgcgcgctcggcagaggctcggttgccagtagcaaccacacgacggcgatttgcagccagggccgccgccgcagccgctggtacctctgcctcctcctacacctcgggctcgagcatttgaaaccctgggggttgccttcggtgacatctcccgcccccacctccagtcctcagtctccaaaatcctcagctctgctcaaaagccagcgcccccggctgggccctgcccccaccgcagacaataggagcggctgggag

SEQ ID NO: 878 - DNA, 292 bp, Homo sapiens
  chr10:22625811-22626103
  hyper
cgggcacctgagcccccaaatccgggcgcgtcgctgagtctcagccccaggtgccctcttcgcggagttgatcagcaattctttttcagtggccaattagaaagcttttcttgacatcagaaataagggtggtgccaaagaaagaagtcaaacgcccactccctttctaataacatcgacacaaagaagagctcatggttgcgtctgcgcttggtaacagtggctttcctctgggttagagccacaggcacaagcacccgctgctatctttcttcttcgcctaccatgaata

SEQ ID NO: 879 - DNA, 190 bp, Homo sapiens
  chr10:22633985-22634175
  hyper
cattcatgtgttgatcggattgtacaatgtgacgtgtgagatttctcgggaccgtcgaagctcagacaactccagggctgcaatttactcgtctggctgccctcgaaccaggctcccttggcgcgtggggctctcccggcgcttggtcccgacccgcgccgcagtcaggataccacggcaatctggggtc

SEQ ID NO: 880 - DNA, 108 bp, Homo sapiens
  chr10:22634324-22634432
  hyper
gcccaggcaccgcggccgtgacgtcacgcccgggactggccgttgcagcaagacggccgcgttccggttccggtaggttgcccgggagacgcgggtacacagagaagc

SEQ ID NO: 881 - DNA, 6 bp, Homo sapiens
  chr10:22634433-22634439
  hyper
gctccc

SEQ ID NO: 882 - DNA, 215 bp, Homo sapiens
  chr10:22634440-22634655
  hyper
tcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgtt

SEQ ID NO: 883 - DNA, 897 bp, Homo sapiens
  chr10:22764693-22765590
  hyper
ctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaa

SEQ ID NO: 884 - DNA, 734 bp, Homo sapiens
  chr10:23483777-23484511
  hyper
aaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctcca

SEQ ID NO: 885 - DNA, 1097 bp, Homo sapiens
  chr10:23488393-23489490
  hyper
ggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggc

SEQ ID NO: 886 - DNA, 886 bp, Homo sapiens
  chr10:23982394-23983280
  hyper
aaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaag

SEQ ID NO: 887 - DNA, 279 bp, Homo sapiens
  chr10:26500592-26500871
  hyper
cctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccgg

SEQ ID NO: 888 - DNA, 246 bp, Homo sapiens
  chr10:26506373-26506619
  hyper
gccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccgggg

SEQ ID NO: 889 - DNA, 518 bp, Homo sapiens
  chr10:26506902-26507420
  hyper
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcc

SEQ ID NO: 890 - DNA, 200 bp, Homo sapiens
  chr10:26727617-26727817
  hyper
agcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggag

SEQ ID NO: 891 - DNA, 183 bp, Homo sapiens
  chr10:26727867-26728050
  hyper
cgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaaca

SEQ ID NO: 892 - DNA, 92 bp, Homo sapiens
  chr10:43429066-43429158
  hyper
cgccggccttcccaggccccgggagccaggaaggtctgaatggagtgatgcgcctggacttttgttcggaaatcccgcgtggagggcggcct

SEQ ID NO: 893 - DNA, 1458 bp, Homo sapiens
  chr10:50605213-50606671
  hyper
ccttgatcttaaagacgcagcgctttggaaacaaaaggcctggcaggcccgccgctggacaccagcgctgggcaaggagcatcgagctgcaggacagagcgctgggtcccggccgccgttgacgcccctccgaaaacagccgggaggaagaccagtcccgctccggtcgaggcaagtcaggatctattccagtgaagcggcccttcctgggctcagtcgctccagagcagagtctgctctgcctcggggaaagaatcacaggaaacttccgctcgtttcagagcggagagagctcggggcgccatttccgccagggccaccgactccgagagtccaggcagccggcccgggaggagcggctagcaggtcccgaaggcgggtgaggtggcaggcaggggccggcagggcagccgagggcctttcctacgtcatgccaagagggctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagttccccatccctgacatcgaccgaggcaagttcctattaaggcccagagatgaccccgggacgagacaggctcatccggcgcggatgagacaggctcagacctgcgcggtctgaggacggcgcgctcgccgagcaacccggcaggtcagaaccctggacagcggcgccggtttccgcacccccacccacccccggctgctgcggagaaagaagccgtaccgggggcccagccggggcccctcgctgctcaggggtgggatccgcccggccggaccccaggcgtccggggaccgaccccaatcctctcccagtccaaacctgcgaaagttactccggacatgcgctcagcgctggcaacagagacaaaactcccttctccgcagtaccacgcgccgctcctacccggccgctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcacca

SEQ ID NO: 894 - DNA, 462 bp, Homo sapiens
  chr10:71331980-71332442
  hyper
atgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggt

SEQ ID NO: 895 - DNA, 15 bp, Homo sapiens
  chr10:72200050-72200065
  hyper
gccccctcccatccc

SEQ ID NO: 896 - DNA, 655 bp, Homo sapiens
  chr10:72200117-72200772
  hyper
cgcccccgagggtgtcccctggtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggcagaatgtggattgaggcgcggaaggggctccctctccgcagcacccacctgctcgccgcgctgggtgcccagaacgcgctgccaggtcctcgagggcgataccctcagatccctgccgtccttgacacccactcccctgcaaatcatggccccgaacccggggttaagcgagacacttgacacttccccggcgcggctggaggacccaaggctgccacagttcgcgacttcgggacagcccatccctgatctccgggccgtgagcccgaatccccgatgttaccagctcagctgccgatactcccgacgtcacaccccgggacccattcaccctcactcgcagaaagaaaaaaaaatcgccaagaccaaaccattacagtaataccaacgaccgttgactgtggctgtgccgggtactg

SEQ ID NO: 897 - DNA, 557 bp, Homo sapiens
  chr10:72200824-72201381
  hyper
cgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggc

SEQ ID NO: 898 - DNA, 159 bp, Homo sapiens
  chr10:94828735-94828894
  hyper
atagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaa

SEQ ID NO: 899 - DNA, 937 bp, Homo sapiens
  chr10:94834033-94834970
  hyper
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgg

SEQ ID NO: 900 - DNA, 119 bp, Homo sapiens
  chr10:99789175-99789294
  hyper
gtcctgtcaggagaacggaagcatctcctgggatgtgcagaagccacactgggtgcacccaccagcagcagcagcggcggcggcggcggcggcggcggcggcggcggcggcagcagcag

SEQ ID NO: 901 - DNA, 32 bp, Homo sapiens
  chr10:99790308-99790340
  hyper
gcttgctcccagccccggtcccgggctggcct

SEQ ID NO: 902 - DNA, 323 bp, Homo sapiens
  chr10:99790437-99790760
  hyper
cgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctggcccggcgcggcgcggcggccactggggtgggcggcggcgaaggcggcggcgagggcgggcgccccccgcgccccgccactgcgtcgcgtaaccttcaggcggcagcgaggcctggcgaggaggggagagggcgcctggctgggcgctgggggccccaggccggagggaag

SEQ ID NO: 903 - DNA, 260 bp, Homo sapiens
  chr10:99790917-99791177
  hyper
cgtcgccgggccgggccaaagcggccgagcgagccgcgctgatggcgagatttcgactacggagctagagccgagccgatctttatccagcctggggacgtgtccgagcacctcccggggactgctcagtatggagagcagggctccgcgacggcccccgcaggcggggagcgggcgagcgcagctcggagatcaggcgcgcagaggcccaggcggctgcgggcagcgccgcttctaccccaccccgtccccaccagcag

SEQ ID NO: 904 - DNA, 74 bp, Homo sapiens
  chr10:100992117-100992191
  hyper
tttgagatagtaatccgggcccgggcccccgcggcttttcgccgggttcctcaggttctggaactgcaggaagt

SEQ ID NO: 905 - DNA, 5 bp, Homo sapiens
  chr10:100992221-100992226
  hyper
cgggc

SEQ ID NO: 906 - DNA, 451 bp, Homo sapiens
  chr10:100993487-100993938
  hyper
tgtaaccagaatggtcgtttggcagaagtctccgggaccgcactccaggacaggcacagtcagggcgtcgcgtgggcctactgtggcaaaggagacgtccgcgcgaatccggtcctggggaaagggcagttccaacaacctttcatccagaagcctgcacagccaatgcgaatgcgccccgccaggacttcttccccgaaaatctgccttccagactcttttctgaggcaggaaagcattaggcgaacaggcagattttttaaaaaaagaaagaaagctggtgggggaaagggggtctgcgcagctgaaggagttcaatgaaagtgggacaagcgttgcggaaaactccgttgcaccctacattcggacgagctcatagacgcgctctgctgcacgaaagagctttcgaagaggaagctgggccgcgcggagctggctgttccgccctcgc

SEQ ID NO: 907 - DNA, 456 bp, Homo sapiens
  chr10:100993939-100994395
  hyper
gcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgag

SEQ ID NO: 908 - DNA, 427 bp, Homo sapiens
  chr10:100995797-100996224
  hyper
ttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttt

SEQ ID NO: 909 - DNA, 327 bp, Homo sapiens
  chr10:101290372-101290699
  hyper
tgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctc

SEQ ID NO: 910 - DNA, 443 bp, Homo sapiens
  chr10:101290700-101291143
  hyper
gaatttttgtgcccgagcgctcgggatccacggcaaaaccaggcacattcctccctctgcagactcaccgcctggtttgtagacactggtctccgcctggggcgtcaatagtttcaggatttaaagcagaaagacaccgggcgcccctgtggctgaggaatggcggttccagcacaagaccctgcccacagagggtctctccctactgcctgcgggccgccgctaccctaagtactccggggcgcacgtggcccgcgcggcatcccagctccccgggcggacccaggggctgcctctccacaacagttccgctcccttctgcagagccccgcctctcccacctcccgacaggctgttctttctcccttcaaccttgggcacccactcctgtcgccgttgcgggacccgcgtggcagccctccaccctcgtacccactcccagc

SEQ ID NO: 911 - DNA, 403 bp, Homo sapiens
  chr10:101292461-101292864
  hyper
caatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattattt

SEQ ID NO: 912 - DNA, 241 bp, Homo sapiens
  chr10:102497525-102497766
  hyper
cttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccc

SEQ ID NO: 913 - DNA, 69 bp, Homo sapiens
  chr10:102507467-102507536
  hyper
taagtaatttccaagcgcaggaaagccgcgccgagggcatcaggcctccgcgggtctcggcgagcgggc

SEQ ID NO: 914 - DNA, 1165 bp, Homo sapiens
  chr10:102589250-102590415
  hyper
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcatag

SEQ ID NO: 915 - DNA, 369 bp, Homo sapiens
  chr10:102893583-102893952
  hyper
ctgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccgga

SEQ ID NO: 916 - DNA, 1155 bp, Homo sapiens
  chr10:102894090-102895245
  hyper
cgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagc

SEQ ID NO: 917 - DNA, 683 bp, Homo sapiens
  chr10:102899173-102899856
  hyper
tttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcc

SEQ ID NO: 918 - DNA, 372 bp, Homo sapiens
  chr10:102900262-102900634
  hyper
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacac

SEQ ID NO: 919 - DNA, 135 bp, Homo sapiens
  chr10:102983245-102983380
  hyper
tggatcccagatcctcgcctccgcctacagccaagcccctcagcttttgcccagagctgctgacttcctcgccgcctccctgcgcaatgggacctagagataagccccaagcccgggtgctagtccaggcagagt

SEQ ID NO: 920 - DNA, 315 bp, Homo sapiens
  chr10:102983434-102983749
  hyper
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggt

SEQ ID NO: 921 - DNA, 455 bp, Homo sapiens
  chr10:102996026-102996481
  hyper
actactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacagg

SEQ ID NO: 922 - DNA, 123 bp, Homo sapiens
  chr10:102996596-102996719
  hyper
cgccaggctcggatctgtgctcagagccgggatccctccgggctgcttcgtcctggccaggactttccttgccctgaagtgaggcgccagggaagctgcagggccctccgccctctctgaact

SEQ ID NO: 923 - DNA, 503 bp, Homo sapiens
  chr10:102998356-102998859
  hyper
ggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcaccc

SEQ ID NO: 924 - DNA, 304 bp, Homo sapiens
  chr10:103043924-103044228
  hyper
cggatggagctgttaatgtaagtggagtttctgcaatggtaattaggagggccctcattaccctggcggagccggctgagagccgataaagccgagggggagaagggccgacatcagggtaatgggggagcagggccattgaggagctggagccgagccggggaccgctccgcgcgcagctggagcccggcgagagggccgcggaaggggggtgcgaaccggggccggaccccggggaggagccgggaggcgagcggcgaggggcactgcgcggctgggtctgccccggggtttcgcactgcgc

SEQ ID NO: 925 - DNA, 99 bp, Homo sapiens
  chr10:103044300-103044399
  hyper
cgtgcctgcctcgcctccagcccggggtaaggagatccacggaggcctctgcgcctaaactcaggtggccagacagagttggggcgggaggcgggtata

SEQ ID NO: 926 - DNA, 79 bp, Homo sapiens
  chr10:115804976-115805055
  hyper
caactggctgggctacgccaactcggccttcaaccccatcatctactgccgcagccccgacttccgcaaggccttccag

SEQ ID NO: 927 - DNA, 95 bp, Homo sapiens
  chr10:118033068-118033163
  hyper
gcttgcggtgggacccgcggccggacccgtactcgcgcacaggacacgcagtgttctgcagccggccgcgggtgctgccagacacacacactctc

SEQ ID NO: 928 - DNA, 454 bp, Homo sapiens
  chr10:118033223-118033677
  hyper
acacacacacacatacacgggcacaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcacccc

SEQ ID NO: 929 - DNA, 145 bp, Homo sapiens
  chr10:118891517-118891662
  hyper
ataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacc

SEQ ID NO: 930 - DNA, 59 bp, Homo sapiens
  chr10:118891715-118891774
  hyper
cgcactataggggctgccaccctctgcccccggagtccccacgccgagactcatcattt

SEQ ID NO: 931 - DNA, 444 bp, Homo sapiens
  chr10:118892013-118892457
  hyper
gagggggagagtttccgacgtaaataatttacaataaaattactattttaaaaaagtgtttttcgcttgcttcagatggatgaatacattctagacactgcggcacctcgcagtctgggtctgtgattttggttaaaatgtgggtggccgtggctgtagggacgatcgccgctgcgcagggtaaggaaagagggtgtcgcggttcgtgttctgatttgggaccactgaaaccctaagactggggaggcgaggggagtgtctttcctatcaatcacacaagacgctatctggactccgagactactgctagaggaggcccgaccacccagcggcgtccctgcctccccttccgcaaagaactgctcagaaatccagacgtttcctgcgtgcaggaagggttttgtgaatccgggtgtttgggagaggaggcaatgagtgctgact

SEQ ID NO: 932 - DNA, 44 bp, Homo sapiens
  chr10:118892517-118892561
  hyper
cgccggctgcgcaggctaccgccggcagccgctttgctctttcc

SEQ ID NO: 933 - DNA, 283 bp, Homo sapiens
  chr10:118892955-118893238
  hyper
agctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatc

SEQ ID NO: 934 - DNA, 72 bp, Homo sapiens
  chr10:118893679-118893751
  hyper
cgagcagcgagggcaccggcaggctgaagaggctgtggcccgcggccggggcgcctgcgtgcaatccccccg

SEQ ID NO: 935 - DNA, 353 bp, Homo sapiens
  chr10:118899892-118900245
  hyper
gccgggtcttgactcccactaccgcgtcgcgggtgcgggtccctgggattcgggtcctcctgatgggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctttaggagccctgcaggcggcggaagtcccaaaccgcagccttggcccaaatgggacccagatggctctgggtccccggcc

SEQ ID NO: 936 - DNA, 113 bp, Homo sapiens
  chr10:118900323-118900436
  hyper
cgcccggtcaaagacctggaagaaagctttttaaaaaataaaaatggcccaacccattacattttcttttaggtagatgggggagctggggggcggggcgggggcagtcaggg

SEQ ID NO: 937 - DNA, 537 bp, Homo sapiens
  chr10:118927026-118927563
  hyper
ttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 938 - DNA, 176 bp, Homo sapiens
  chr10:122708495-122708671
  hyper
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcg

SEQ ID NO: 939 - DNA, 38 bp, Homo sapiens
  chr10:123922645-123922683
  hyper
gctgcctccaggacccggggcctgaaggaggcagaagc

SEQ ID NO: 940 - DNA, 535 bp, Homo sapiens
  chr10:124895161-124895696
  hyper
ccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggc

SEQ ID NO: 941 - DNA, 624 bp, Homo sapiens
  chr10:124895832-124896456
  hyper
cgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggc

SEQ ID NO: 942 - DNA, 113 bp, Homo sapiens
  chr10:124901934-124902047
  hyper
ccctcaacaggctcccggcaccgcagagccagaggccacgcggtgagaaccccagtgcgtgcgctcttcttgtgtgagaggccggaggtagagttgggagaaagaggagccgg

SEQ ID NO: 943 - DNA, 431 bp, Homo sapiens
  chr10:124902138-124902569
  hyper
cgggagggcggtgctgccggctgcttcctgcaagcggtttgaagaggcatcgcgttgtccggccgcctgcgcaagggccacgcgctgctgctttcacccccttgcgcccgcggggcacctggactccccttaagagtccccgtggggcctgagcttctgctgggcgctacgctgccctccacgattccattttgccccatttactcgggtcgtccacttcccgcggctcagtgacccagccagggggcgtcttccgctagcggtccaaatgtagactccgcaaagaggctaagaagacctgtctacccgggtgcgcgcgatggggtcagggtgtaagaaccaggagcctcatagaaacctctgcttggggtccaaagcccagccgggcactcccagaggacaacatccgcccccgcatgtacacgtggccc

SEQ ID NO: 944 - DNA, 214 bp, Homo sapiens
  chr10:124902607-124902821
  hyper
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttg

SEQ ID NO: 945 - DNA, 267 bp, Homo sapiens
  chr10:124903040-124903307
  hyper
agggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgagg

SEQ ID NO: 946 - DNA, 146 bp, Homo sapiens
  chr10:130085053-130085199
  hyper
agggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 947 - DNA, 76 bp, Homo sapiens
  chr10:130085200-130085276
  hyper
gaggagcccccgcccgccggcggccagcgcacagcccggccaggggcgccctccctgccgccgccggccctttgat

SEQ ID NO: 948 - DNA, 54 bp, Homo sapiens
  chr10:130085355-130085409
  hyper
cgcacgggtccccgggccgcggcgcgctccccgccacgccgcacatcaaggccc

SEQ ID NO: 949 - DNA, 84 bp, Homo sapiens
  chr11:17741806-17741890
  hyper
ctgcaggctctgctgcgcgaccaggacgccgcgccccctggcgccgcagccgccttctatgcgccgggcccgctgcccccgggc

SEQ ID NO: 950 - DNA, 135 bp, Homo sapiens
  chr11:17741952-17742087
  hyper
cggcatggtaaggccgggaccccaggaagtgaggaagttagggcggcgctcgggatatcagggacgcgtttccgagggcggggagctggccttgcgggaggtttgggccaggatccttcccgagagagaggaccc

SEQ ID NO: 951 - DNA, 344 bp, Homo sapiens
  chr11:20229223-20229567
  hyper
gcctcccaaagtgctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggacc

SEQ ID NO: 952 - DNA, 30 bp, Homo sapiens
  chr11:20618363-20618393
  hyper
tgttttttaatactgcggttccatcctctg

SEQ ID NO: 953 - DNA, 503 bp, Homo sapiens
  chr11:20618422-20618925
  hyper
cgcacgacctgctgccccagggcctggcttcctgcctccgcatgctctctcccgcccctgaagcccaaccttcaagccctgctgatgcccgcccctccgtcccagcgttggcctcatagcgaaccctcttaggcctctccgttccagaccctccctccattctccacgtagcccctcccttctagaatcttgcggctgaaagtgggggcaggcggggagcccgaatagcgcctcagccaaaccccgcagccgttcctgcgcgtcacccgcctctgcagagcctgacgcgcggcagtctccacgccggaacccaagtgctcactgggccggggagggccagcgggcgaaatatcaggcctgggggctgagcgggggcgctgggcgtcactcaggcccagggccgcagctgggggaagtgagaaggccggcaggattctgcccactctgcgcagttctcccttcctcccggggcagccaagtctgtgcgccctggaacgtccggg

SEQ ID NO: 954 - DNA, 101 bp, Homo sapiens
  chr11:20623258-20623359
  hyper
cgcgagagaggccagccgggccgtggcgggtgcacgtatgctgatggggaaaccggttggcagtgccaggtgatggatgcgggaggcggctttggggcttc

SEQ ID NO: 955 - DNA, 26 bp, Homo sapiens
  chr11:20691060-20691086
  hyper
gccagcggtggggggcgggctggggg

SEQ ID NO: 956 - DNA, 40 bp, Homo sapiens
  chr11:20691121-20691161
  hyper
cgagcgcagcacccggcgctgccgagccacctcccccgcc

SEQ ID NO: 957 - DNA, 218 bp, Homo sapiens
  chr11:20691162-20691380
  hyper
cccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagacca

SEQ ID NO: 958 - DNA, 185 bp, Homo sapiens
  chr11:20691431-20691616
  hyper
cggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttc

SEQ ID NO: 959 - DNA, 90 bp, Homo sapiens
  chr11:20691747-20691837
  hyper
cgcagagggagcgcttccggctggcgggcgcggccggggcccgggagggcgcggtgcggcgagggcagagagctgcgggagaaccctggg

SEQ ID NO: 960 - DNA, 197 bp, Homo sapiens
  chr11:27743436-27743633
  hyper
ctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggg

SEQ ID NO: 961 - DNA, 1042 bp, Homo sapiens
  chr11:31819319-31820361
  hyper
actcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgc

SEQ ID NO: 962 - DNA, 565 bp, Homo sapiens
  chr11:31820460-31821025
  hyper
cgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtct

SEQ ID NO: 963 - DNA, 29 bp, Homo sapiens
  chr11:31826042-31826071
  hyper
acaggcgtttgggggatctgggctccggc

SEQ ID NO: 964 - DNA, 198 bp, Homo sapiens
  chr11:31826106-31826304
  hyper
cgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagcca

SEQ ID NO: 965 - DNA, 325 bp, Homo sapiens
  chr11:31826408-31826733
  hyper
cgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggc

SEQ ID NO: 966 - DNA, 117 bp, Homo sapiens
  chr11:31827113-31827230
  hyper
gggcctggtttcgctgggcctccaggctcccaggtcggagctctagactagccctgccgcgtaccagcacccaccacgaacaggaaggtgggtgggaccccacggggtctgggcaga

SEQ ID NO: 967 - DNA, 457 bp, Homo sapiens
  chr11:31827597-31828054
  hyper
cgccctgatcagcccagcccctctctccggggtcagagcccgggcaggggcgagagggggtgtgagttacaggatttgggggggatggggtttctctaccgcagcttcgaaaactcgggcgggctgttcttaagggcccagcccctgcttctccagtatcgagaagagccaagcaaacgccctcccctcccgggctgccgggcgcggagcggggagcagccgccgcaggtccccgggcctcagtcggtcggcggccgggccagcgcgggcgtcgcgagtccctgtgtcctcccctgaccctcgggtccgcgcaccccgagcccgaagtcccagaaagaccagaggcacttactgttctgcatgctggctctggctgggggccgcgggattccacggggctcgaatatggggctctgttagcaagaaaataggagttaatcctcgggcagctgcatca

SEQ ID NO: 968 - DNA, 438 bp, Homo sapiens
  chr11:31836032-31836470
  hyper
aactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaat

SEQ ID NO: 969 - DNA, 159 bp, Homo sapiens
  chr11:31837354-31837513
  hyper
aattcggcgcttttcgtcacttcctaacccagtctcacagagggtgacttccaaacctggctagcggggaaaaccgctgcccgggggacagaggggctgacaggaactgcgggttggctcagccgaatgcggccggggagaatttaagaattctcagcc

SEQ ID NO: 970 - DNA, 735 bp, Homo sapiens
  chr11:31837541-31838276
  hyper
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggag

SEQ ID NO: 971 - DNA, 315 bp, Homo sapiens
  chr11:31841774-31842089
  hyper
ctctggagaccctaccagaaatctagtgctgggggctcctctccgcgcctgccaccagccttggaggaagctgggcagggccccgtgtggtgcccagcctacgaggtcccacctcgcctctccctggcagaggcatcctctctaggccacactggctcgcattgcgggaagaagggcaccgcgggcggcccgggggcatcatcgacgactcgtagagccccaaatgccgagtgctacctgaggcaggctgtagctggggtgaaaaggaccggaagcgggaaagaaacctcttttctttcaggcctcccttcagcc

SEQ ID NO: 972 - DNA, 110 bp, Homo sapiens
  chr11:32455906-32456016
  hyper
cagagccagacactgcgccggtctcctggttccactcccgtggggactagcagtcccggaatctctcggactctaaggggccccagacgccctcccggctcttgcgaaca

SEQ ID NO: 973 - DNA, 454 bp, Homo sapiens
  chr11:43602393-43602847
  hyper
ctgattggtgggtgacgattttagtccgcaccaatgagctggcggcctcgtctgtatttatttagtgctctgggggagtttttctctttacgcagcgcctgtagtcacggctggaaccttggctgggggactctgagggataagaggggattcggggggaatccgaactgtacctgttcagagatccgcgaccttgcagccggggctggcggaactctgatagggagatagagggataggacaggcaggcggggaggctccgggtgctggggcgacaggaaaggggtggaggctgggctccgggatccgggtgcccctctgcggtccccttctcgccctccacacacttctctcggggctgagttgggggatcgcggacggtctggagaaatggagacacgagtccaggggcgcggaggggcgggcagcgcgcggagtggtgagactgagccgc

SEQ ID NO: 974 - DNA, 189 bp, Homo sapiens
  chr11:43602848-43603037
  hyper
atggaacgcgctggggagacccagcctgttcggctccagggttcggagacatcctgggctgaaggcggcggcgaaccgaagaagccggcatattctgcccttcgcgaatctttttgcggtctgggcttgctgtacataactcaatagccggaagcccttaccccaaaaagcatttgcggagggcgcact

SEQ ID NO: 975 - DNA, 112 bp, Homo sapiens
  chr11:43603076-43603188
  hyper
cgcaccttcccgaagctgctccatccgagccttacccggccctttccccgttttccacggaagattcggccctttcccccgtcctttccgcggtgcccgaggctttggtcac

SEQ ID NO: 976 - DNA, 81 bp, Homo sapiens
  chr11:44330877-44330958
  hyper
cggtttggggaaatgccgaagggaccgggaaaaacaaactccaagtcgagtttaacagccgaaacgctccgtgcctaggcc

SEQ ID NO: 977 - DNA, 481 bp, Homo sapiens
  chr11:44330959-44331440
  hyper
gcggacaagaaggagacagaacagatcccttggctccctcgcagcgatcgatcccgtttaccgaccagagtcaccaccccgcccccagcccgccaactcatacctcccgcaagccaccagtttcaagggatgcggaagccaagcaccccgtggtccccagcaccaggtgacccgcacgtgcactcaccgtagcagggaacctgcaaggccgcgctgtggccgctgctgccttcctggagtttgaggctgccgtccgggggcgtcttgcaggcgcctcgctgcaagtaaagatgcggttgcgcgggcggctggggctgcggctgctgctgctgcggctgcggctgcggcggcggctggggctgcggggtcgacggctggggctggaacttgttaaaggagccccgcgccccagctccactctccaggggtgtcgccaggtcctgctgcccagcgccgtaacgggcccggctcttggcgtccc

SEQ ID NO: 978 - DNA, 229 bp, Homo sapiens
  chr11:44331482-44331711
  hyper
cgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggc

SEQ ID NO: 979 - DNA, 15 bp, Homo sapiens
  chr11:46316818-46316833
  hyper
gtaccattactgccc

SEQ ID NO: 980 - DNA, 461 bp, Homo sapiens
  chr11:46316895-46317356
  hyper
cgagatggagctgcaaggggatttaaggcccggctcgccctttgagtcggggtcgtcggggagaccctcggtctccacttctccctgcgggggtgggggcggggccgcgctactgatgaggggtttaggacaccgtgagacggccaggccatttctgcctcggccccagacgcagaaggggtcccatgcaggcccgagccagtgcaccctgcgctccctcagccgcgggccgtcggcgcaggccgggaccctcctccgcgcgagccctgcactcctccggtgccctccacgccgccaccggctgctgctcgcagcctcccgccattggccaggagctctgcggctcccaccagtgagcaggccggattccggtgaggggcggccccgggtgttcccgggttaaccctttgtgggccgctccaggacggcggcacccggatccttctctaaaatttaaaggg

SEQ ID NO: 981 - DNA, 290 bp, Homo sapiens
  chr11:46317407-46317697
  hyper
cgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctctt

SEQ ID NO: 982 - DNA, 153 bp, Homo sapiens
  chr11:60718701-60718854
  hyper
ggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 983 - DNA, 145 bp, Homo sapiens
  chr11:60718976-60719121
  hyper
cgctccccgggcacgcggggctgctcccgggcgcgcggcgcgggcatcctggctccgggctgggccccccgcggctcttctctcctctcctctccccgcctcagagccctgcactcctgcccccgggcctcggccctctccccca

SEQ ID NO: 984 - DNA, 762 bp, Homo sapiens
  chr11:65600895-65601657
  hyper
cctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 985 - DNA, 73 bp, Homo sapiens
  chr11:65816447-65816520
  hyper
cctccaaccccatgccggccactgcagtactcacaccgcacgcctgggctctgcctctggcccgggttggggg

SEQ ID NO: 986 - DNA, 4 bp, Homo sapiens
  chr11:65816560-65816564
  hyper
cggg

SEQ ID NO: 987 - DNA, 75 bp, Homo sapiens
  chr11:66188095-66188170
  hyper
aattagtgtcagtgccggcccctctctgccctctgcggactcctgccgcgggcttcaggccgccctaaacctggc

SEQ ID NO: 988 - DNA, 38 bp, Homo sapiens
  chr11:88241938-88241976
  hyper
tggcggccgcagcctcgggaccggccgcggggctctcc

SEQ ID NO: 989 - DNA, 145 bp, Homo sapiens
  chr11:88242130-88242275
  hyper
cgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcag

SEQ ID NO: 990 - DNA, 42 bp, Homo sapiens
  chr11:88242358-88242400
  hyper
cgggcgccgggaagtgctcctcagcctcggccacatcataca

SEQ ID NO: 991 - DNA, 286 bp, Homo sapiens
  chr11:111411296-111411582
  hyper
ccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaac

SEQ ID NO: 992 - DNA, 391 bp, Homo sapiens
  chr11:111411821-111412212
  hyper
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactcca

SEQ ID NO: 993 - DNA, 38 bp, Homo sapiens
  chr11:115530058-115530096
  hyper
aaagacaccagagaccgggagggtgcagctgggctctt

SEQ ID NO: 994 - DNA, 201 bp, Homo sapiens
  chr11:115530221-115530422
  hyper
cgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctgga

SEQ ID NO: 995 - DNA, 323 bp, Homo sapiens
  chr11:122849801-122850124
  hyper
gcgcccggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 996 - DNA, 232 bp, Homo sapiens
  chr11:122850148-122850380
  hyper
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatcttt

SEQ ID NO: 997 - DNA, 308 bp, Homo sapiens
  chr11:122850901-122851209
  hyper
gggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctc

SEQ ID NO: 998 - DNA, 15 bp, Homo sapiens
  chr11:123228701-123228716
  hyper
ctttccataccttcc

SEQ ID NO: 999 - DNA, 392 bp, Homo sapiens
  chr11:123228788-123229180
  hyper
cgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggccgacactgaagaaacgtagatgcacagggaggggccaatattagtgtacagagagaaagagggaacacggtgcggtgacacctagcctcggagacagtgggagctccgagcccacggagagc

SEQ ID NO: 1000 - DNA, 226 bp, Homo sapiens
  chr11:123229181-123229407
  hyper
ggggagttccgcttcctcccgccccagcggctcccgccccgcctgggcgcagccggccgtcccggctccgagggtgcagcgcgcccgggcgcagcgcgagtgcgtggagccgggctccagcacgaccccgccgctcgggtttgggtgtcctcaggctccgcgctcctcctcccctcctccagatgggactggctctcctctttgcaaagccaggctcgcggggaga

SEQ ID NO: 1001 - DNA, 15 bp, Homo sapiens
  chr11:123301014-123301029
  hyper
actgcctcttcctcc

SEQ ID NO: 1002 - DNA, 944 bp, Homo sapiens
  chr11:123301082-123302026
  hyper
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccaggg

SEQ ID NO: 1003 - DNA, 181 bp, Homo sapiens
  chr11:125773880-125774061
  hyper
gttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcc

SEQ ID NO: 1004 - DNA, 312 bp, Homo sapiens
  chr11:125774122-125774434
  hyper
cggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggag

SEQ ID NO: 1005 - DNA, 189 bp, Homo sapiens
  chr11:128564685-128564874
  hyper
tgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 1006 - DNA, 2 bp, Homo sapiens
  chr11:128564875-128564877
  hyper
tc

SEQ ID NO: 1007 - DNA, 308 bp, Homo sapiens
  chr11:128564991-128565299
  hyper
cgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctgg

SEQ ID NO: 1008 - DNA, 459 bp, Homo sapiens
  chr11:129242783-129243242
  hyper
gagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccc

SEQ ID NO: 1009 - DNA, 350 bp, Homo sapiens
  chr11:129243304-129243654
  hyper
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaacatctattttctc

SEQ ID NO: 1010 - DNA, 347 bp, Homo sapiens
  chr11:129243954-129244301
  hyper
atgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 1011 - DNA, 204 bp, Homo sapiens
  chr11:129244440-129244644
  hyper
cgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaa

SEQ ID NO: 1012 - DNA, 203 bp, Homo sapiens
  chr11:131780876-131781079
  hyper
ggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgc

SEQ ID NO: 1013 - DNA, 449 bp, Homo sapiens
  chr11:132952552-132953001
  hyper
gccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggcacccgtgtgc

SEQ ID NO: 1014 - DNA, 774 bp, Homo sapiens
  chr11:134145653-134146427
  hyper
tcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccc

SEQ ID NO: 1015 - DNA, 232 bp, Homo sapiens
  chr11:134146444-134146676
  hyper
cgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgcc

SEQ ID NO: 1016 - DNA, 217 bp, Homo sapiens
  chr11:134146677-134146894
  hyper
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggct

SEQ ID NO: 1017 - DNA, 335 bp, Homo sapiens
  chr12:4274054-4274389
  hyper
agctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactag

SEQ ID NO: 1018 - DNA, 808 bp, Homo sapiens
  chr12:5017990-5018798
  hyper
gtaggcgggaggcaacggtggtgagaagggtggtcccaaggccgcgggaggagccaatcagcggcgactctgggctcttgcagcctccttagagactccgcagccctggaggtaccaagctgcctgctgccttttctcgcgctgcaggcgcggagatgcagcgcctctgggggcgcagctccagccgcactcgcagggcaaggcacacgcccccggctcctgctgccatgcgcctctgcgggggaccctttccaaataaattgcaagctttgaaagtggccctgtggaggcactaggctggggaaaaaggctgcgggaggagggacatagggtgggaggtgagtaggcgacttgcttctcagattattcccaattagcaccaagttggcagacaaccccacaaacccacgaagccttcggtcccccacaagtcacattccctgtatttcagaataatcggatcgtaagaaaacttcaagtcccatcgtaggttaaagagggacaggctcttagtaccgccgccgcccagtaaaactacatggaacaaacccagggatcctcatctgcacagctctgcccaaagtctgcagctctgcgagtccagccggcgggggaagctgggtgggccccgcagagagcaagggccttcttgggggaggagcgggatggggcgcagagcagtgcgatcgaagagggttactgtgggactgcacaaaagcaaacccgtcggaggagttttgccagaaacaccaccgcctgcattgcgtcggacctgaccatttccaatgtgaaattcccggggaaggtc

SEQ ID NO: 1019 - DNA, 6 bp, Homo sapiens
  chr12:5018799-5018805
  hyper
cgagcc

SEQ ID NO: 1020 - DNA, 229 bp, Homo sapiens
  chr12:5018806-5019035
  hyper
ctaggggccgttcgtgggcggggcggcgggccacaggggaagtagagttagcggtcggcttttctggtaggagaggaaaaagctgtgctggcaagggtgggaactgaatgacaaccccgctctcttccaaaccaccccctcatattttccatccacctcctcgctcctgccctcccccgccctccccaacccacgcccgggtgggccaatcgctgctcggtattccagg

SEQ ID NO: 1021 - DNA, 659 bp, Homo sapiens
  chr12:5019084-5019743
  hyper
cggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccaggtagggggttccccagctcggggatgcagaagcgggggttggggggaccgggtgggggaggccgggggtgcggggatgctgtccgggaccctgagcttcccccgg

SEQ ID NO: 1022 - DNA, 397 bp, Homo sapiens
  chr12:5019793-5020190
  hyper
cggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggccca

SEQ ID NO: 1023 - DNA, 68 bp, Homo sapiens
  chr12:14133813-14133881
  hyper
gaaggggcacactgacgcgcgcacacacgcccccgacgcgcacgcgccccgcgcgcactcacactcac

SEQ ID NO: 1024 - DNA, 71 bp, Homo sapiens
  chr12:22093889-22093960
  hyper
gatttgagtaggagacggcagttttgaagtaaaactggaaacctgatccccaccccttcacttctcgagcc

SEQ ID NO: 1025 - DNA, 308 bp, Homo sapiens
  chr12:22093961-22094269
  hyper
ggcctcgtcccttaattctagaaatagcgatcgcgaaagctaagtgccgagaagtgcgagagagtgcgagggcgtttttggatagcagaaatgttagctcaaaatcgacaacttacagttattcctaaaaatgtttaaatggcattcatgtaaaagacacggattcacttactccgatgacagttttcctcccctaggcgaagcacgcagtgcgccggaacggattatttttagggtggtgggagaccagctgctgcctcctatcgagtttctaaattgcacagactgctctgggccggggcagacac

SEQ ID NO: 1026 - DNA, 471 bp, Homo sapiens
  chr12:22094577-22095048
  hyper
cgctgtttccccctgaacggatccgggaaatgaagggctcattctaggtagaggcacccactgctgggttatgagtgcacgaatgtctcacaggagcaaggctggctcaagtctaattttccgcttttccccggcgacctagaaaacttggtttctctggtggaccagccgccgcgctatcgaagggcgacccttgcccaccgtcccctaaagtgagacgctgattcccatggactgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagc

SEQ ID NO: 1027 - DNA, 83 bp, Homo sapiens
  chr12:22486799-22486882
  hyper
aaggacatggaagagcggatgaaagggatgcctctgcgagacggtgcaaggcggtcctcgccggtgaccctgtcctctgcact

SEQ ID NO: 1028 - DNA, 300 bp, Homo sapiens
  chr12:22487133-22487433
  hyper
cgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcaga

SEQ ID NO: 1029 - DNA, 1227 bp, Homo sapiens
  chr12:48397123-48398350
  hyper
acaccacgcagcctggctcggtgagttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgcccccc

SEQ ID NO: 1030 - DNA, 90 bp, Homo sapiens
  chr12:49374937-49375027
  hyper
gtattctccgagatgcgccaggagtgcaagtgccacgggatgtccggctcatgcacggtgcgcacgtgctggatgcggctgcccacgctg

SEQ ID NO: 1031 - DNA, 57 bp, Homo sapiens
  chr12:49375115-49375172
  hyper
cggagctgctgcgcctggagccggaagacccggcccacaaaccgccctccccccacg

SEQ ID NO: 1032 - DNA, 255 bp, Homo sapiens
  chr12:49390850-49391105
  hyper
gtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 1033 - DNA, 788 bp, Homo sapiens
  chr12:49391146-49391934
  hyper
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttag

SEQ ID NO: 1034 - DNA, 634 bp, Homo sapiens
  chr12:49729728-49730362
  hyper
cgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 1035 - DNA, 94 bp, Homo sapiens
  chr12:50297461-50297555
  hyper
aggggaggatgctttcgtggtccagagggcttgctgaggatgacagggagccgggagccggaggatggaggatggtgcaggctggggagatgcc

SEQ ID NO: 1036 - DNA, 115 bp, Homo sapiens
  chr12:50297973-50298088
  hyper
gtgaaaccagagccgggcatcagggcctcatctccactgtctctgcacctctctgcagctccagctgcgcctctgccttttcctcctccctctttggatgcggccctgatttctg

SEQ ID NO: 1037 - DNA, 79 bp, Homo sapiens
  chr12:52652141-52652220
  hyper
gtccgcaggagccggcgcggaagcccccgcacacgctgtggctgccgaagcctccggtgaggccgcggtagcaggagac

SEQ ID NO: 1038 - DNA, 14 bp, Homo sapiens
  chr12:52652599-52652613
  hyper
gagtggaacccctc

SEQ ID NO: 1039 - DNA, 378 bp, Homo sapiens
  chr12:54321250-54321628
  hyper
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtg

SEQ ID NO: 1040 - DNA, 48 bp, Homo sapiens
  chr12:54345611-54345659
  hyper
ccacctatagttttgcgcatggtcagcgaagtgccggcgggttaagcc

SEQ ID NO: 1041 - DNA, 14 bp, Homo sapiens
  chr12:54345965-54345979
  hyper
ggtgggtctcaggg

SEQ ID NO: 1042 - DNA, 180 bp, Homo sapiens
  chr12:54354514-54354694
  hyper
ttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggc

SEQ ID NO: 1043 - DNA, 38 bp, Homo sapiens
  chr12:54354814-54354852
  hyper
cggaaggttccggtgtaattcagcgggaggtggaaggc

SEQ ID NO: 1044 - DNA, 43 bp, Homo sapiens
  chr12:54379888-54379931
  hyper
ggccccagaccatttcgggaatgcgaccctggctttcgactag

SEQ ID NO: 1045 - DNA, 406 bp, Homo sapiens
  chr12:54379958-54380364
  hyper
cgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggca

SEQ ID NO: 1046 - DNA, 88 bp, Homo sapiens
  chr12:58025646-58025734
  hyper
ccagaccacccccagcgagcgctgcgctgcgccgccgcggtcggcactcaccccactacttgctccttgatcctgaccgggatgtgtg

SEQ ID NO: 1047 - DNA, 190 bp, Homo sapiens
  chr12:62584823-62585013
  hyper
cgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 1048 - DNA, 963 bp, Homo sapiens
  chr12:62585030-62585993
  hyper
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggc

SEQ ID NO: 1049 - DNA, 88 bp, Homo sapiens
  chr12:63544512-63544600
  hyper
agggcttcggcctcccggcttgtgttgccagcgccggtggccagaggccaccatgggctggagttgcccgagggccccgcgtcgggac

SEQ ID NO: 1050 - DNA, 146 bp, Homo sapiens
  chr12:63544728-63544874
  hyper
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggt

SEQ ID NO: 1051 - DNA, 232 bp, Homo sapiens
  chr12:65218319-65218551
  hyper
tgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggc

SEQ ID NO: 1052 - DNA, 281 bp, Homo sapiens
  chr12:65218900-65219181
  hyper
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagac

SEQ ID NO: 1053 - DNA, 179 bp, Homo sapiens
  chr12:65219605-65219784
  hyper
cgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgtt

SEQ ID NO: 1054 - DNA, 20 bp, Homo sapiens
  chr12:75601480-75601500
  hyper
ggtcgctggccctgccgccg

SEQ ID NO: 1055 - DNA, 247 bp, Homo sapiens
  chr12:75601695-75601942
  hyper
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtcc

SEQ ID NO: 1056 - DNA, 14 bp, Homo sapiens
  chr12:95942964-95942978
  hyper
gcgtggcaaactcc

SEQ ID NO: 1057 - DNA, 485 bp, Homo sapiens
  chr12:103351501-103351986
  hyper
tccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 1058 - DNA, 104 bp, Homo sapiens
  chr12:103352051-103352155
  hyper
cggcgccggccagcagccccagccgcagccccagcagcccttcctgccgcccgcagcctgtttctttgccacggccgcagccgcggcggccgcagccgccgcag

SEQ ID NO: 1059 - DNA, 97 bp, Homo sapiens
  chr12:103352170-103352267
  hyper
cgcagcagcagcagcagcagcagcagcagcagcagcaggcgccgcagctgagaccggcggccgacggccagccctcagggggcggtcacaagtcagc

SEQ ID NO: 1060 - DNA, 15 bp, Homo sapiens
  chr12:103352268-103352283
  hyper
cccaagcaagtcaag

SEQ ID NO: 1061 - DNA, 259 bp, Homo sapiens
  chr12:103352313-103352572
  hyper
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgcct

SEQ ID NO: 1062 - DNA, 263 bp, Homo sapiens
  chr12:103889253-103889516
  hyper
gccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 1063 - DNA, 197 bp, Homo sapiens
  chr12:103889517-103889714
  hyper
accaccgcgacgggttccgccgcttgcctccgctccttggcctttgctgccgtgctgcctcttctcacgggcgcggctggagtcccggggagcagcagagagcaaacggtccggctctacctcaccctgccagggggcgagtcccgcgctccctgcgtctacctggagctgcagggtccctatcccggggcgccgcc

SEQ ID NO: 1064 - DNA, 24 bp, Homo sapiens
  chr12:103889788-103889812
  hyper
cgcagtcgccgggcaaccacaatg

SEQ ID NO: 1065 - DNA, 78 bp, Homo sapiens
  chr12:104609448-104609526
  hyper
cacgggctatgacttcgctgttgtcaccgagcgccccgcccaccgcgttctccgacccgcggccggcagggggctcgc

SEQ ID NO: 1066 - DNA, 270 bp, Homo sapiens
  chr12:104609527-104609797
  hyper
gcctccgccaggcgtccttcggctccgtcagttcccacagggccttgtgcgacatgggctgcgccgagggcaaggcagtggcggcggccgccccaacggagctgcagacgaaaggcaagaacggcgatggccgccgtaggtcaggtacgaccgagggcgaaggcctggtccccaggtcgacgggccgaagcgggccttccggccggggttggggataaagtgccccggagccctggccttgaagcccctcactggagtcagtgactgacc

SEQ ID NO: 1067 - DNA, 628 bp, Homo sapiens
  chr12:106980911-106981539
  hyper
cgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtt

SEQ ID NO: 1068 - DNA, 492 bp, Homo sapiens
  chr12:108168922-108169414
  hyper
tctaagattctgtttcgtcttcttctattgagagattgacctcttgagtgatttgtgtgctttccggcaaatgatggagacgcgtaaaccggcggaacggctggccttgccatactcgctgcgcaccgcgcccctgggcgttccggggaccctgcccggactcccgcggagggaccccctcagggtcgccctgcgtctggacgccgcgtgctgggagtgggcgcgcagcggctgcgcacggggatggcagtacttgcccgtgccgctggacagcgccttcgagcccgccttcctccgcaagcgcaacgagcgcgagcggcagcgggtgcgctgcgtgaacgagggctatgcgcgcctccgagaccacctgccccgggagctggcagacaagcgcctcagcaaagtggagacgctccgcgctgccatcgactacatcaagcacctgcaggagctgctggagcgccaggcctgggggctcgagggcgcggccgg

SEQ ID NO: 1069 - DNA, 34 bp, Homo sapiens
  chr12:108169549-108169583
  hyper
cgcacagcgcgcagccgggcgctcaacctaaggt

SEQ ID NO: 1070 - DNA, 325 bp, Homo sapiens
  chr12:113012954-113013279
  hyper
ggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggtaaggcgggcgggggctgcgggccaccaggtcctgccctcccaagctgcagcacgcgctggctggggggtcgtgggggctcccgtgggggcgcggccggacgcgggacgctgcctccgggaatggggctgctggagcgggaggatgcgctagaac

SEQ ID NO: 1071 - DNA, 79 bp, Homo sapiens
  chr12:113541522-113541601
  hyper
gcatacgccaagcagcgtcctatgctctttgtgtaaatcaagtcatttaattatcacaactccacgagataggcactgt

SEQ ID NO: 1072 - DNA, 438 bp, Homo sapiens
  chr12:113541661-113542099
  hyper
aggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgac

SEQ ID NO: 1073 - DNA, 401 bp, Homo sapiens
  chr12:113900758-113901159
  hyper
ctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtc

SEQ ID NO: 1074 - DNA, 24 bp, Homo sapiens
  chr12:113901407-113901431
  hyper
cgaagtaggcgggggacccgggac

SEQ ID NO: 1075 - DNA, 53 bp, Homo sapiens
  chr12:129337857-129337910
  hyper
ggtggaaacagaccgcggctaccctggtgatggaccccacggggcacacccgc

SEQ ID NO: 1076 - DNA, 239 bp, Homo sapiens
  chr12:129338587-129338826
  hyper
cggtgccagccctgccctcgcggatcgggtctcggctgtgtgccggcgtccggggtcctgtccccgaagtccctttcccacctcccctctgccctgtctattctcgtcttcctggctggttagctccttcacactcatctttttctgcctttgtcttatttgtttacttgttggtctgtgttctggtcgctggaacgcaagcccggcgggggcccggggaggggccgccgcgttaatcc

SEQ ID NO: 1077 - DNA, 55 bp, Homo sapiens
  chr12:129338851-129338906
  hyper
cgctcggcctgtattagccggataaacatattccttgaggcgaagcctgggaagt

SEQ ID NO: 1078 - DNA, 120 bp, Homo sapiens
  chr12:130647950-130648070
  hyper
cggacgagcccacccggggctcgggcctgttcccgccgctgttccggccgcagcggccccacagcgcgcaggagcacccgctgaaggacgggggccccgggcgcggcggctgcgacaacc

SEQ ID NO: 1079 - DNA, 15 bp, Homo sapiens
  chr12:133481368-133481383
  hyper
gaagcttttcctcac

SEQ ID NO: 1080 - DNA, 31 bp, Homo sapiens
  chr12:133481489-133481520
  hyper
cgccacgagccacaatcgtagggttgggcgc

SEQ ID NO: 1081 - DNA, 134 bp, Homo sapiens
  chr12:133481521-133481655
  hyper
ccctgccggccaccaggggcagcgcaggagctgagcgcaccccatcagcgaaagaagcgcgcctccccgctcttttctgaaccgtatctcctaaactataattttggagatcaaaagtgcggtggagcctcctc

SEQ ID NO: 1082 - DNA, 187 bp, Homo sapiens
  chr12:133485161-133485348
  hyper
ggcaacgtagaggcggggaattcgccaacgtgtctgaaacagacaacaattttagccaacggctgcgtgggccttgggcgtcctggccaatgggaatagtgaggggcctgtcactaagaaacctgtccctgagcaacgcataggaggggtggaacccagcagcgctgactgagccgccgcgaagtgc

SEQ ID NO: 1083 - DNA, 251 bp, Homo sapiens
  chr12:133485439-133485690
  hyper
cgcctcgggccgtccccgcccagacgcttgtccccgcgagaagctgagcgcactgaagtgagcccggcggctgccgccggaggaggagcccggctctggacacggccgtcaggaagctcagaggctgcagcaccgcttctgcgttgatttccgcttgacttttactcttttcttgggttaaaaatcaaacgccgacccgaggcgtcagagatgggcggtcgttaggcgcagtggcggcccccggatgtttg

SEQ ID NO: 1084 - DNA, 481 bp, Homo sapiens
  chr13:23733629-23734110
  hyper
agacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcg

SEQ ID NO: 1085 - DNA, 75 bp, Homo sapiens
  chr13:25319830-25319905
  hyper
ccagaacaacgagggcgacgaagacaggactgaggaacatgcgcccctgccgccctcacccggaaccagggctcc

SEQ ID NO: 1086 - DNA, 295 bp, Homo sapiens
  chr13:25320734-25321029
  hyper
atttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactgg

SEQ ID NO: 1087 - DNA, 1072 bp, Homo sapiens
  chr13:25321112-25322184
  hyper
cgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgac

SEQ ID NO: 1088 - DNA, 26 bp, Homo sapiens
  chr13:25744709-25744735
  hyper
aggcagggtctggggcggcgggcgcc

SEQ ID NO: 1089 - DNA, 295 bp, Homo sapiens
  chr13:25745300-25745595
  hyper
cgagggagcccccgccgggccctgcggctctggggggccccgggttcggccgccccccgccgcccccgccgctgtcgcccccgccgcgcggctcctccttcctgccgctctccagcaccagcacctcggcaagtccgtcgtgggtcctgctcctcaccagccccgtcggacccgagcttttcccgtcccctttgtttttgaccccaaaaatgctgggcatggtgccacccgatttcctcttcttgaataatttgaaggcagctttattaatcttccccgacggcggctcggcggc

SEQ ID NO: 1090 - DNA, 221 bp, Homo sapiens
  chr13:25745726-25745947
  hyper
cgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcg

SEQ ID NO: 1091 - DNA, 54 bp, Homo sapiens
  chr13:25946620-25946674
  hyper
caaaaggctccaggccggggcgaggtgagcggcgggcgtcagagacccccggct

SEQ ID NO: 1092 - DNA, 18 bp, Homo sapiens
  chr13:25946801-25946819
  hyper
cggcgcagagaagatgca

SEQ ID NO: 1093 - DNA, 95 bp, Homo sapiens
  chr13:28366482-28366577
  hyper
gaaataatgaggaagcgtgcagagtgaatgccaagagaaaaggcacaaaaaccctattgagaggccccggccgctcctggcgtagtccatcacat

SEQ ID NO: 1094 - DNA, 152 bp, Homo sapiens
  chr13:28367794-28367946
  hyper
aatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 1095 - DNA, 84 bp, Homo sapiens
  chr13:28368153-28368237
  hyper
cgctgattcccaggcacccgcagccaaaccactgcctggcatggatttggcactgctttgcagaggtcccgggcctgggcaggg

SEQ ID NO: 1096 - DNA, 77 bp, Homo sapiens
  chr13:28368994-28369071
  hyper
tctggagtagacaggcgccaacccggattgggcctcccttctgggaagggttggggatccagttgcagggtccgagc

SEQ ID NO: 1097 - DNA, 850 bp, Homo sapiens
  chr13:28369161-28370011
  hyper
cgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggt

SEQ ID NO: 1098 - DNA, 171 bp, Homo sapiens
  chr13:28674056-28674227
  hyper
ggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctgg

SEQ ID NO: 1099 - DNA, 436 bp, Homo sapiens
  chr13:28674720-28675156
  hyper
gctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccg

SEQ ID NO: 1100 - DNA, 1213 bp, Homo sapiens
  chr13:29067773-29068986
  hyper
tgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgag

SEQ ID NO: 1101 - DNA, 182 bp, Homo sapiens
  chr13:29068993-29069175
  hyper
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagcc

SEQ ID NO: 1102 - DNA, 114 bp, Homo sapiens
  chr13:29106308-29106422
  hyper
gtctccccagaggctcgtttcgaacccgcagctagccaagggcaaatgcatactcgaaagtgccacgcctctcgtccaccctgcgccgcgtccagtccacccccttcatcccgc

SEQ ID NO: 1103 - DNA, 392 bp, Homo sapiens
  chr13:29106423-29106815
  hyper
ccccatgtccacccgcccgctgtccaccctgcgccccatgtccatgcgccccctgtccacccgctcactgtccaacccgcgccccatgtccacccgcctgctgcccaccccgcgcccccagtgcacccgcccagccccgagcgcccgcggagccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggt

SEQ ID NO: 1104 - DNA, 60 bp, Homo sapiens
  chr13:29106898-29106958
  hyper
cgccctgaggtcagggccggggcctgaggacacggcgctgggctccgggggacgcgggtt

SEQ ID NO: 1105 - DNA, 739 bp, Homo sapiens
  chr13:44947737-44948476
  hyper
cgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctggg

SEQ ID NO: 1106 - DNA, 780 bp, Homo sapiens
  chr13:49794146-49794926
  hyper
ctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacc

SEQ ID NO: 1107 - DNA, 336 bp, Homo sapiens
  chr13:53312978-53313314
  hyper
cttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 1108 - DNA, 17 bp, Homo sapiens
  chr13:53313512-53313529
  hyper
cgcagcacagggccttc

SEQ ID NO: 1109 - DNA, 83 bp, Homo sapiens
  chr13:53313530-53313613
  hyper
ccccaggacctgcaccctctaccggccacgggacgtccctccgcacccgcctgtggatgccgtgacccctgcacactcatacg

SEQ ID NO: 1110 - DNA, 37 bp, Homo sapiens
  chr13:53313677-53313714
  hyper
cggtggcacgcacccctgagtccgaactgtggaacct

SEQ ID NO: 1111 - DNA, 592 bp, Homo sapiens
  chr13:58208334-58208926
  hyper
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagcca

SEQ ID NO: 1112 - DNA, 37 bp, Homo sapiens
  chr13:79170347-79170384
  hyper
cggtagctgtcctgcagtccgagcggagctgcgacct

SEQ ID NO: 1113 - DNA, 372 bp, Homo sapiens
  chr13:79170467-79170839
  hyper
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgt

SEQ ID NO: 1114 - DNA, 242 bp, Homo sapiens
  chr13:79175702-79175944
  hyper
ggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagccca

SEQ ID NO: 1115 - DNA, 49 bp, Homo sapiens
  chr13:79176077-79176126
  hyper
cgatgccgctgccacctgcccggccgccgccgccgccgctgccgctgcc

SEQ ID NO: 1116 - DNA, 145 bp, Homo sapiens
  chr13:79176276-79176421
  hyper
gggccgccgccgccgccccccgggccgccaccgccgcctcccccggggccgccgcccgggccgccgccgccgcccgggccgccaccgccccccgggccgtcgtgggcgccgccgccgccggccgccgcgcccgcgccgcccgcgc

SEQ ID NO: 1117 - DNA, 224 bp, Homo sapiens
  chr13:79176608-79176832
  hyper
ggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcag

SEQ ID NO: 1118 - DNA, 104 bp, Homo sapiens
  chr13:79177081-79177185
  hyper
aaagtagagggaagtcgagagtcctggccccagcgctccctactccgatcgcaggcgcctgacgcggaggcagaggcagacaggaacacgacattaagggccgc

SEQ ID NO: 1119 - DNA, 318 bp, Homo sapiens
  chr13:79177305-79177623
  hyper
cgcgggccggggccgcgggcgtggggcgcttaccggcggcgtgggcaggcaggcccgccggatggcctcggagctggagtgcagcgacgggtacttgtgctcagggagggtgggatgcatggcaaagtgaggctgcttgctgttcatggacatcatcgtggcggcttggcatgtatatccacaaacactccgaaagtccgcgggaaagtgcgtacgccggctcacccggcctcccttcggaggctgcagccgcggcggtcgcggcggctggcggcggccccgccgcgggctgctgctgctgctcctgctgctgccagg

SEQ ID NO: 1120 - DNA, 175 bp, Homo sapiens
  chr13:79177885-79178060
  hyper
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgc

SEQ ID NO: 1121 - DNA, 51 bp, Homo sapiens
  chr13:100642150-100642201
  hyper
cccccacactactccaccgaaatgatcggaagggcgcgctaggcctgcttc

SEQ ID NO: 1122 - DNA, 227 bp, Homo sapiens
  chr13:100649349-100649576
  hyper
gtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 1123 - DNA, 86 bp, Homo sapiens
  chr13:100649799-100649885
  hyper
cgggcatgtgagggacttgagtgaatgcagctccctcaactcactcccgcaaaaccacagccaagagggccttaagtcagagaacc

SEQ ID NO: 1124 - DNA, 230 bp, Homo sapiens
  chr13:102569312-102569542
  hyper
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctc

SEQ ID NO: 1125 - DNA, 930 bp, Homo sapiens
  chr13:112712048-112712978
  hyper
ccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggc

SEQ ID NO: 1126 - DNA, 260 bp, Homo sapiens
  chr13:112715354-112715614
  hyper
gggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaag

SEQ ID NO: 1127 - DNA, 417 bp, Homo sapiens
  chr13:112715936-112716353
  hyper
tctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 1128 - DNA, 361 bp, Homo sapiens
  chr13:112758012-112758373
  hyper
tgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagc

SEQ ID NO: 1129 - DNA, 196 bp, Homo sapiens
  chr13:112758495-112758691
  hyper
cgagggagccccttatcccggtgacagaatgggacaagctgggaaaggcttagaccacacaagtccaaggctcaccaggccgcagaaagcctgccttgggaaccgggggtcattatccgccctattcagcggggcccggggaccctgggggccgagcgaggccagcccgggcgggagcaccgccgccagcgcgcgc

SEQ ID NO: 1130 - DNA, 348 bp, Homo sapiens
  chr13:112760850-112761198
  hyper
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttcc

SEQ ID NO: 1131 - DNA, 323 bp, Homo sapiens
  chr14:24803594-24803917
  hyper
ctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 1132 - DNA, 205 bp, Homo sapiens
  chr14:24803918-24804123
  hyper
gcccggcgggccccacctgagcttttctcacccgctcaaagccgctaccaccccgcgcccccaacctcgtggcaatcccgtctcctttttcaggccctccctgcggcctcccagcccgctcccagctggcgatgaggggatccctcagtcctttcctcctcctccctcaaacccggattgtagaggtgccctagaaaagcctcat

SEQ ID NO: 1133 - DNA, 23 bp, Homo sapiens
  chr14:24804424-24804447
  hyper
cgcctccccgcttcagccccttc

SEQ ID NO: 1134 - DNA, 439 bp, Homo sapiens
  chr14:29234853-29235292
  hyper
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctct

SEQ ID NO: 1135 - DNA, 84 bp, Homo sapiens
  chr14:36973454-36973538
  hyper
ggaacgcaggctgaggtcaggctgaccacgccgcctcctcagtcgccgtatcgcggggctggcggccagcgccttagaagagcc

SEQ ID NO: 1136 - DNA, 171 bp, Homo sapiens
  chr14:36986301-36986472
  hyper
ggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 1137 - DNA, 249 bp, Homo sapiens
  chr14:36987301-36987550
  hyper
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcatta

SEQ ID NO: 1138 - DNA, 175 bp, Homo sapiens
  chr14:36990858-36991033
  hyper
gctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctgggggg

SEQ ID NO: 1139 - DNA, 92 bp, Homo sapiens
  chr14:36991094-36991186
  hyper
cgacgccgggcttaagcgaaccacagaggagaactggcaacgctgaatacagaccttgtctgcaggcgcgacctggccgggcctgagtcccg

SEQ ID NO: 1140 - DNA, 178 bp, Homo sapiens
  chr14:36991600-36991778
  hyper
tggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 1141 - DNA, 37 bp, Homo sapiens
  chr14:36991988-36992025
  hyper
cgaaaataagcccggagactaacgcaccttgtaggga

SEQ ID NO: 1142 - DNA, 453 bp, Homo sapiens
  chr14:37123566-37124019
  hyper
ggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccg

SEQ ID NO: 1143 - DNA, 91 bp, Homo sapiens
  chr14:37124481-37124572
  hyper
cgtggactcttggccagcagtgaggaggacaaggttgcagatcctctttgctgcgggttctgggtccggccttgggcggcattctgtcttc

SEQ ID NO: 1144 - DNA, 264 bp, Homo sapiens
  chr14:37132290-37132554
  hyper
cgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccag

SEQ ID NO: 1145 - DNA, 33 bp, Homo sapiens
  chr14:37132602-37132635
  hyper
cggccgccaaggtgcccacgccacccggggtgc

SEQ ID NO: 1146 - DNA, 382 bp, Homo sapiens
  chr14:38724978-38725360
  hyper
gggccctgggcctgcccgcaggagcgcgagcacagcgcgcagctcggcgcccgcacgcacggtgctgagcgccccacctcgcaggatgcaggcctcctcggccgcctgccgcttcatggtagcgtggtgcaggctgtagcaggcccccgaggccgagcagccagcacggtcggcagtggggtgttcgccgccgcccggcccgggccagagcgcctgccagaggaggcacagggcgaacgccggcctcattctctgaggccccgcacgcagagctgctcccaacttggatctgtcccgctcgaggacgcagagctgtgtctggagcgcggtcaccgccctctacagctggcttccccaacccggttccccctcccttcccctc

SEQ ID NO: 1147 - DNA, 385 bp, Homo sapiens
  chr14:51560329-51560714
  hyper
gtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 1148 - DNA, 523 bp, Homo sapiens
  chr14:51560770-51561293
  hyper
cgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgc

SEQ ID NO: 1149 - DNA, 226 bp, Homo sapiens
  chr14:51561294-51561520
  hyper
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggg

SEQ ID NO: 1150 - DNA, 379 bp, Homo sapiens
  chr14:52534648-52535027
  hyper
tgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 1151 - DNA, 209 bp, Homo sapiens
  chr14:52535055-52535264
  hyper
cgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgta

SEQ ID NO: 1152 - DNA, 91 bp, Homo sapiens
  chr14:52535334-52535425
  hyper
cggcatcgctctctggccgggtaccaccgcaagggtgctggggggctccaggagtggggtctgtttcctcccctctggaggcagggtttcc

SEQ ID NO: 1153 - DNA, 332 bp, Homo sapiens
  chr14:52535426-52535758
  hyper
tgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgcccc

SEQ ID NO: 1154 - DNA, 214 bp, Homo sapiens
  chr14:52535759-52535973
  hyper
gcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggc

SEQ ID NO: 1155 - DNA, 92 bp, Homo sapiens
  chr14:52535974-52536066
  hyper
gggtaaaagctcctggccagggctgcctggagctgccccttccactccgcccccagggagctcccgggtcatcctctcatccgggctgcccc

SEQ ID NO: 1156 - DNA, 38 bp, Homo sapiens
  chr14:52536067-52536105
  hyper
cggcccccaaggagccccacccccgggaccaaatggcc

SEQ ID NO: 1157 - DNA, 50 bp, Homo sapiens
  chr14:52536342-52536392
  hyper
cgcttcgctccacccagagacgccctgaggagaagcgagcctttgtacga

SEQ ID NO: 1158 - DNA, 220 bp, Homo sapiens
  chr14:57260875-57261095
  hyper
attcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggt

SEQ ID NO: 1159 - DNA, 234 bp, Homo sapiens
  chr14:57261174-57261408
  hyper
cgcggtcccggagcgcggcgggaagaacgcccacgtcacctcccggtgttgttacacccacaatcaccacactctgacccccgcaaagaccacagaggagtaggaagagggctgccctcgtactccccaagccacccccgcctctgagcgcggaggcacgatgttctggggctcgagccttcgcatccaccgggccagcgctaaccaccggccgccgccctggaggggacccgg

SEQ ID NO: 1160 - DNA, 382 bp, Homo sapiens
  chr14:57261465-57261847
  hyper
cggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccac

SEQ ID NO: 1161 - DNA, 567 bp, Homo sapiens
  chr14:57264079-57264646
  hyper
catttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 1162 - DNA, 43 bp, Homo sapiens
  chr14:57264764-57264807
  hyper
cgtcagcggctcatcctaccgggagacctggaaaaccagcagc

SEQ ID NO: 1163 - DNA, 93 bp, Homo sapiens
  chr14:57265147-57265240
  hyper
gccctgggaccggcgcccccgaggcctgagaactacgcccggggggcgcgggctgaggctcaagagaggtcctaggtgcgggccagggatgga

SEQ ID NO: 1164 - DNA, 15 bp, Homo sapiens
  chr14:57270957-57270972
  hyper
aagatgtctgggtac

SEQ ID NO: 1165 - DNA, 28 bp, Homo sapiens
  chr14:57271153-57271181
  hyper
cgcagcagtcccccgttcctcacagccc

SEQ ID NO: 1166 - DNA, 322 bp, Homo sapiens
  chr14:57274417-57274739
  hyper
gattctctccacaaccggcctaggtatgcactctgcatagaaggcatgggcccttcaatctaactttcaaagctcttttcctctcgaagcagggtccagaacggggaaaagaaataacttttgaaaaatccacgcctcactatgactgctcacgaggtggcctctggagaactcatacctagaagctgaccgcggtcgcgcggcgagttccggcagccggtcggcgaccgcacctccgggcgcgagtgcctgggtcccgcgttcctgcccggcagccccgcagccccgcagccccgcagccccgcagccccgcaggcctggc

SEQ ID NO: 1167 - DNA, 310 bp, Homo sapiens
  chr14:57274740-57275050
  hyper
cccgaggtcccgctccactgcccgcgccccccgcgcagccttatatctaacggtcaattcgtgcaatctgtcgcttctccctcccccacgccttgttttttttttcttccaagaagcccatctaccagttgctgtgtcctcgctcaacaataattacctcgtccgagaattaattataataaatgttttcttgataaactaacgagataatccgaggggcacacgtcccttaattacaggccgccatgctcctctctgcttctcgtccgggctgattaattttctgcatgatggaaaggaaacaaaacta

SEQ ID NO: 1168 - DNA, 17 bp, Homo sapiens
  chr14:57275210-57275227
  hyper
cgcgagggagggaggaa

SEQ ID NO: 1169 - DNA, 417 bp, Homo sapiens
  chr14:57277979-57278396
  hyper
gaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtgg

SEQ ID NO: 1170 - DNA, 69 bp, Homo sapiens
  chr14:57278694-57278763
  hyper
atttacagcaattaacgaattacgggagtgcgcacgaggcagcaagctctcggcagccgggctccggct

SEQ ID NO: 1171 - DNA, 728 bp, Homo sapiens
  chr14:57278837-57279565
  hyper
cggcccctcgagcccccgaggggcccggagcccgcccagctccttcccggccctctgcagcagctccagtccggagacccgctggctgtcgcgttcccaggagtcaagagtttctaggggcccgggcgggggggagggtgagtaccgaccttttttctcaccccacccccactgtactgaaacacctggcggccgcccccgaagcctttaatggggatggtggtgaggagggggtaacaaatgccccgggcgttatgaccctcgtggcgctggctgtcggaggcactggttgggtgcgcttggtcagagtcatgatgctttcgatgaaggaaaggcaaatccacctcgatcacctgaagcagagtctccttcctacccctagaaaagacaacgtttcccccagtttgatcacaatgatgtttaaagcataaaagagccgaaaaagaaaaatggacgttgtgaatctggcagaggggaaggccggaggaaggccttggggacagtgggcatggggtgggatggagaatgatcagaacatgcgcttgtgagctaaaccaagtaaaccattttggactgggagatccatctgccgtagggtccagtgtccagggtaacctttcaagcccgatgtagaggtttgcgatgtcctcccagatggcgggggcagctgaatctccctaaaaatccccctgttctattcgacaggggcagatttatgcatggtgggg

SEQ ID NO: 1172 - DNA, 110 bp, Homo sapiens
  chr14:57283299-57283409
  hyper
catacctgagatacacggtgcaaacgcccccggctccctcctttcccaattcacccacttcttaatttgagtttcttaatgtgcaagcgccagggccggctgtggtcagg

SEQ ID NO: 1173 - DNA, 592 bp, Homo sapiens
  chr14:57283445-57284037
  hyper
cgcccctgccggcgggtcgccgggtctcgagctgcgccgccccgctggaggcgccggggctgcctggctctccgcgcaaacctcgcgcccttccgtttgcgcgcatggagccgggtgagggcggccgcggccaccgcgcgatggaggatttggaagctcagagccagctggtacattttgagaaatttagcaaaccagactgggctgcctcggaaactgggttctgttctgactcatttgcagaaaagttatggggaaaaacatcttgtaaaattaaggttatgtttggcgggtacagtcttgagcgcacatggtcatccggcgaatcagccaagttttccaaagcgccccctctccagctctcaggccaggggagcaaagcgtaggtgtgtgcgtgtgcgtgtgcgcgcgcgcgtgtctctgtgtctgcgtgtgtgctcgcaagcgcgtgtgggtttggggtggggggacatcctgacctttctacaccctagtgcgtcccaactccagactgggaggagacgtctgcggcctctggtcttttcccttcttggacgaggtgcggccagctgagacctcacaccggccacct

SEQ ID NO: 1174 - DNA, 541 bp, Homo sapiens
  chr14:57284070-57284611
  hyper
cgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaa

SEQ ID NO: 1175 - DNA, 225 bp, Homo sapiens
  chr14:60952195-60952420
  hyper
cgtgtagcaaaattctaacgaaagcccttccccaacacccgggtaaacctagagaaacagtgcgatttcgcatttacgaatttaccacgaagaataaaaaaattggaggttttcacagaacagccaattcgcattacggcatacgcctgaggcggggttcctgtctaccgtgcccctcagagcccaggaaccacagcccgtgcgcctcccgcagtgggagttcgc

SEQ ID NO: 1176 - DNA, 117 bp, Homo sapiens
  chr14:60952516-60952633
  hyper
cgggccgcaccaacccaggggataaggcgactccggtcgctctgaggggcagggccagccagccccctcccacccacgcacacgctccccctcagagccgccggcccagagaaaaac

SEQ ID NO: 1177 - DNA, 218 bp, Homo sapiens
  chr14:60952729-60952947
  hyper
cgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgt

SEQ ID NO: 1178 - DNA, 311 bp, Homo sapiens
  chr14:60973697-60974008
  hyper
tgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcc

SEQ ID NO: 1179 - DNA, 441 bp, Homo sapiens
  chr14:60975448-60975889
  hyper
ttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccgg

SEQ ID NO: 1180 - DNA, 440 bp, Homo sapiens
  chr14:60976074-60976514
  hyper
cgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacaca

SEQ ID NO: 1181 - DNA, 258 bp, Homo sapiens
  chr14:60982110-60982368
  hyper
accttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcg

SEQ ID NO: 1182 - DNA, 316 bp, Homo sapiens
  chr14:61104241-61104557
  hyper
cggttgcaccccggacccctgcagctgtggacgccggagctgtgcgcagtcatcctgagccagcccgcggggcccgatcggaagggacgcctctcctaagagctggcctggagtcctggagcctccaagcgggcaagtaggggccgcaaaggctgggctgggcctccgctgaggccctcgggggcctctgggccctcatggcctggaggccgcgcggcccaagcccctagagcagaggccgcgctagcctgcaggggtcgacgcagggccggaggcagcggcttttccttcccactccgggttgaccctaaagaca

SEQ ID NO: 1183 - DNA, 241 bp, Homo sapiens
  chr14:61104623-61104864
  hyper
cgaaactggcccggaggggggcccaggcctcacgcgcccggctctctcccagctctcctcctcctccttctcgggctcagaaagccttccagccgcggccccagccctccccccagcctgtgctgggctccgctttccctccatcaactccaagccgaattcaatccgagaaggctcctttgagcttttgtgtttgctgggggagatgtgggcgcaggagggatcgcgttacaactttcat

SEQ ID NO: 1184 - DNA, 220 bp, Homo sapiens
  chr14:70654070-70654290
  hyper
ggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 1185 - DNA, 306 bp, Homo sapiens
  chr14:70654291-70654597
  hyper
ctagcctctgaatcagggctttgactgtgtgtgtgtgtgtgtgtgtgtgtgtgtgtgtgtgtgtgtccgcgcgcgcgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 1186 - DNA, 41 bp, Homo sapiens
  chr14:70654598-70654639
  hyper
cgccgagtggataacgcgcttccctgctagcccccaaaccc

SEQ ID NO: 1187 - DNA, 147 bp, Homo sapiens
  chr14:70654640-70654787
  hyper
gcggacactcacagcaccagaagcacaacacgccctggcccaggtggcacacatatgccgacatgcatccagcacacacaacacagcagtcagtctccccaaacagcacccgctaccaacccagcatgctcacgatccaactgtacc

SEQ ID NO: 1188 - DNA, 351 bp, Homo sapiens
  chr14:74706046-74706397
  hyper
tttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 1189 - DNA, 605 bp, Homo sapiens
  chr14:74706940-74707545
  hyper
cgtggtgcagagtcgccggccgtgtcggagggccccagcaccgctgctccactgcggccccggcctggtgtaggatccgcactcctcgagcccgatgctgttccggctccggccccatccctggtgtccaaagttgtctgattcccaaatcccgcgctggtcaactggggtttatttttcacccccacgagctcagacaacccggccatcgcggcagctaaagcggccgccatcctctcccacgtaagcgccactatatactggagcccggggacgcgcgggctcggggaccctgggtgacctctccgccttctccccgcgctgctttccgggaggtgtgtcgcggcccgctcgaacctccgattcctgtttgagcttggcaattcccccgatttttcgttgcgttttactttgttttacgtggaaaggcaacgaaaaccagcgcgtcgcaggctctcgggcctcgagtagggacgcattgtgccgccttgcgaaaaggacggtgctcggcagcccccagtcttcccggagcccagctccccacgcctccgctccgctcctcgctcctcgaggccaactttccggcccggggcattggggctggc

SEQ ID NO: 1190 - DNA, 176 bp, Homo sapiens
  chr14:74707572-74707748
  hyper
cgagcgctgccggggatctctgcggccccctaaggctgcctcgctctccgtcgtcccggtcccaagcgcgccggggcctttgcctctcttacaacgaaatctgttcaaaacctccggattcgggccccggcgcgggagaggtcagcctgagctcagggatgggacggccaccgggg

SEQ ID NO: 1191 - DNA, 120 bp, Homo sapiens
  chr14:74707791-74707911
  hyper
cgcggaggcagcccggggtggggccctcgcgggtttcgggcacagcggagcgcgtcccccactctgccgcatgtccctacgcccgcttttcagattctgaagatgtttcctccagcgatc

SEQ ID NO: 1192 - DNA, 418 bp, Homo sapiens
  chr14:74707912-74708330
  hyper
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctc

SEQ ID NO: 1193 - DNA, 70 bp, Homo sapiens
  chr14:89817946-89818016
  hyper
tcctttgaggccccccggaactggcagcaggccgacgggcaatcgttcctctggccgcacactttcaagt

SEQ ID NO: 1194 - DNA, 212 bp, Homo sapiens
  chr14:95239421-95239633
  hyper
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcat

SEQ ID NO: 1195 - DNA, 261 bp, Homo sapiens
  chr15:28341719-28341980
  hyper
gggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 1196 - DNA, 39 bp, Homo sapiens
  chr15:28341981-28342020
  hyper
cagggccccccgggactggcggccccgcggcaggccagg

SEQ ID NO: 1197 - DNA, 15 bp, Homo sapiens
  chr15:28342521-28342536
  hyper
cggccccaaggagct

SEQ ID NO: 1198 - DNA, 334 bp, Homo sapiens
  chr15:34786610-34786944
  hyper
caccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 1199 - DNA, 103 bp, Homo sapiens
  chr15:34787232-34787335
  hyper
cgccccgagccggccactggctacacgctgcagttccgctccggcaatgtggccttccgcgactgcgagggccgttacctggcgccgtcggggcccagcggca

SEQ ID NO: 1200 - DNA, 291 bp, Homo sapiens
  chr15:37180507-37180798
  hyper
cttcaaacactgccccgacggtctccattctcatcacaatctgaccggcctcccccatcagaccagcatttcccccgcgcggcactttctcccagccccggccccgacggagggggcccgccccggcgcgcgacgccctgagttgatgactgcaactgtaactgggacgggccccccgtgcccccatagtttgcaatacgttggtctaactctaacacacgcgcccagggaaggccaggtgagggccagggtagccctctgcacgcccctctgccgcggcccaagcctctg

SEQ ID NO: 1201 - DNA, 76 bp, Homo sapiens
  chr15:45403605-45403681
  hyper
gcccggtggcggggtcgggcgccgcccacatgagcagggggttctgcgagtctcgggggaaagcggggtcgggccc

SEQ ID NO: 1202 - DNA, 202 bp, Homo sapiens
  chr15:45403798-45404000
  hyper
cgggtgagcccgggtcgagaggcggcggcgggccagggaaggccggggcccggcgggtgtccgcggctggggagtgggcgcctctcccctccaggccctgccaggcccgaagcccaggccccacctggctggggtgcggtcccttcccgccgccttccccgcctcaccaggtcccgggggttgctgggactccgtccggtct

SEQ ID NO: 1203 - DNA, 71 bp, Homo sapiens
  chr15:45479446-45479517
  hyper
agagtttggggcttccgtctcagattagtcggttgagaatctgaacaaaggtgggtgaaggctcggaaccc

SEQ ID NO: 1204 - DNA, 3 bp, Homo sapiens
  chr15:45479774-45479777
  hyper
ggg

SEQ ID NO: 1205 - DNA, 438 bp, Homo sapiens
  chr15:48936775-48937213
  hyper
accaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgc

SEQ ID NO: 1206 - DNA, 432 bp, Homo sapiens
  chr15:48937214-48937646
  hyper
gtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttc

SEQ ID NO: 1207 - DNA, 638 bp, Homo sapiens
  chr15:48937709-48938347
  hyper
cgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagac

SEQ ID NO: 1208 - DNA, 162 bp, Homo sapiens
  chr15:48938348-48938510
  hyper
gttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctg

SEQ ID NO: 1209 - DNA, 15 bp, Homo sapiens
  chr15:53075850-53075865
  hyper
acaaaacaaaggaac

SEQ ID NO: 1210 - DNA, 1016 bp, Homo sapiens
  chr15:53075985-53077001
  hyper
cggatacaaaatccaagtacgcatcttttttggggaggttagagctgaggtgtacttcggaagatgagaattttgttttcatgaattgggtaacacccaggcattgttaggtaccccgacagaccctctagatatccttctcttcctccttcacactttcttcctatcaaaatagttattgttttgaaattcactagaacaacgacgttctaaaaacaaaggcgcagcaagcatccctttcttcgctgccgcgggctgaaccacggacgctcgcgggtcgcccagccccgacggcccgcagggggcgcgcgccgcagccgcagcacagcccggctacccccagaaagggagccgaatggagggaagcagggagcgcggagggctcgaggcttgcagataaggagaggcgcatcctgggatttgggtcctctgctgctacaacacaaccgtgctattgttggcactgtccgacccaagtgtcggtggtaagcggcgatgtcggggctgggtctctagcaaccgctgtgccctgggtcaggctggtcgccccagctaccgggatccctctccggatgcttccagggcgataggtgctgcacccattgacgggatagccgcatacctccgaacaggtagtggagttcgtctctggcaggcatcctagctgcgctgacaccaaggtcgccacacaatagccatcagccccccttaagccccagaagtaggtttcccctgccccagccatagcggttccagtcgtcgccacgagcccacttcttatccccaagcgcacctccctctcctcacccgggtttatgcccgttacacagagagaactacacagggggaactatggtcctacaccctcgaggggacagacaccggccgtgagacaggcaccacgcagagccttctggtgactgtccgcaggagcgagaccttttttggttttgcagtcggctaggtgtgtgtgtgtgagggtccccagttgactaccgggatgcactgccactttt

SEQ ID NO: 1211 - DNA, 461 bp, Homo sapiens
  chr15:53077065-53077526
  hyper
cgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatg

SEQ ID NO: 1212 - DNA, 548 bp, Homo sapiens
  chr15:60287038-60287586
  hyper
tgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaag

SEQ ID NO: 1213 - DNA, 33 bp, Homo sapiens
  chr15:60287643-60287676
  hyper
cgagtccagtgcccgtgccggggagcattccag

SEQ ID NO: 1214 - DNA, 266 bp, Homo sapiens
  chr15:60295917-60296183
  hyper
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctct

SEQ ID NO: 1215 - DNA, 18 bp, Homo sapiens
  chr15:60296600-60296618
  hyper
cgctgccaccatccgcgc

SEQ ID NO: 1216 - DNA, 256 bp, Homo sapiens
  chr15:60297153-60297409
  hyper
aggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggca

SEQ ID NO: 1217 - DNA, 809 bp, Homo sapiens
  chr15:68121149-68121958
  hyper
cggttcattaaaacacgaatcattaaccggatgcgaaaggcgtcatttatgccgcggacggggcactggcgggagggaaaatgcctaaaaggaggcgggtgcagagggtggaggacactttgaacgcccctcggcttgggagccgctttgtgtttagagtaattttcccgagggcgctaacaattaccctgaatctacaagggggcaagggtgcgccgcgtgcgtcactgtgcccgctcaagtccagcgggcgcaccaacctttgccactccgtcggctttccctcttggccgcggggtagggctgggcgtctttgggccgccgcagggcgccaccctaatcgcctgtcatttctcggccgtcgcaggtgttcgcgcccgagagggatgagcacgtgaagagcgcggcggtggcgctggggcccgcggcctcctacgtctgcacccccgaggcccacggtaacgcctgtcgcggccgctggccactgtaatgggggaaccgcagacagagggccggggtcaaggaaggcctgcgaaggaagacaaggagagagacgcagagaaagagggagagggaaagaaaaataatgaaaacaaggaagctaagctagtactcccaacaacttccaatctttagttacttaaaaacaacagtgacaacgccctctccaccacacgcacacacatgctgcagtacacccagacacggcgttaaacccttaacaaaatcacgcccgacacggccttcaaatcctctcatttattcagcaagtgtgtttggccgcggggtcccctttggctaggccggat

SEQ ID NO: 1218 - DNA, 488 bp, Homo sapiens
  chr15:68125223-68125711
  hyper
gattgaacttcttatcgcggcaatttccatggtttctaaattaaaaatcgaggcgtaaaattacctgggaagtaatgcctaagtttgctttaattttggttagatccatctgcctttaagcgccatcccaggccatttccttcctccgccagtctgcagttaggagctccggtaccccctcccccatccctggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaaggtgcggaagccgggaaacaaagataggaggggtgctgggtgccggccgtgctgtcgactgaatgaatgaatagtgggactagtgaggaaggccacgatccacgtggatcaggatct

SEQ ID NO: 1219 - DNA, 29 bp, Homo sapiens
  chr15:76627508-76627537
  hyper
tcctaaaggtggaggcggagctcaaaagc

SEQ ID NO: 1220 - DNA, 251 bp, Homo sapiens
  chr15:76627575-76627826
  hyper
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgc

SEQ ID NO: 1221 - DNA, 281 bp, Homo sapiens
  chr15:76629814-76630095
  hyper
ctctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgc

SEQ ID NO: 1222 - DNA, 29 bp, Homo sapiens
  chr15:76630096-76630125
  hyper
gccccgcgcccttccccggcagagaagcc

SEQ ID NO: 1223 - DNA, 244 bp, Homo sapiens
  chr15:76630519-76630763
  hyper
ggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccg

SEQ ID NO: 1224 - DNA, 900 bp, Homo sapiens
  chr15:79382098-79382998
  hyper
cggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgcc

SEQ ID NO: 1225 - DNA, 258 bp, Homo sapiens
  chr15:79382999-79383257
  hyper
agccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaactt

SEQ ID NO: 1226 - DNA, 67 bp, Homo sapiens
  chr15:79383317-79383384
  hyper
cctgccctccctcccctcatctccccttctctccctcggatgttaaaaagcaaatcagatcaatttt

SEQ ID NO: 1227 - DNA, 81 bp, Homo sapiens
  chr15:79383438-79383519
  hyper
cgccccaccgcggcgcactgtagacctggggttaagtgccagttgtcattttctcctccaaaggctcgcccccccccccca

SEQ ID NO: 1228 - DNA, 64 bp, Homo sapiens
  chr15:84115747-84115811
  hyper
ttcttaaacatacaccgagcgaaaatgcgccggagggaggcgatgttgcctgtgagccaaagcc

SEQ ID NO: 1229 - DNA, 42 bp, Homo sapiens
  chr15:84115812-84115854
  hyper
gttcggcaccaagacagaagcagagagaactgatctctctcc

SEQ ID NO: 1230 - DNA, 194 bp, Homo sapiens
  chr15:84115931-84116125
  hyper
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcga

SEQ ID NO: 1231 - DNA, 42 bp, Homo sapiens
  chr15:84748578-84748620
  hyper
gagtctcaggggctacgaacaaacgttttatccccgggtagc

SEQ ID NO: 1232 - DNA, 691 bp, Homo sapiens
  chr15:84748678-84749369
  hyper
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgc

SEQ ID NO: 1233 - DNA, 492 bp, Homo sapiens
  chr15:88799507-88799999
  hyper
cctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 1234 - DNA, 302 bp, Homo sapiens
  chr15:88800000-88800302
  hyper
gagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagac

SEQ ID NO: 1235 - DNA, 555 bp, Homo sapiens
  chr15:88800412-88800967
  hyper
cgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagct

SEQ ID NO: 1236 - DNA, 289 bp, Homo sapiens
  chr15:89346038-89346327
  hyper
agactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctc

SEQ ID NO: 1237 - DNA, 115 bp, Homo sapiens
  chr15:89346346-89346461
  hyper
cgcaatgcagatgcgggccctccagcccttctcgcgccgccttcctcccgccagccccggagctgccgggtccgcgccgccccggggagcgctcctctcccgccctgagcgcagg

SEQ ID NO: 1238 - DNA, 383 bp, Homo sapiens
  chr15:89903431-89903814
  hyper
cccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaa

SEQ ID NO: 1239 - DNA, 248 bp, Homo sapiens
  chr15:89922499-89922747
  hyper
ggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggcca

SEQ ID NO: 1240 - DNA, 326 bp, Homo sapiens
  chr15:89949616-89949942
  hyper
cggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccaggga

SEQ ID NO: 1241 - DNA, 126 bp, Homo sapiens
  chr15:89950355-89950481
  hyper
ccccaggagtccctccgcccgctcccagtccgcaagcgcagaggatcctgcgctctgtcccccaaggtcttggcgtttgctgagctctctccgcgcgcgtcgaggagaggccgcctctcgtgagca

SEQ ID NO: 1242 - DNA, 308 bp, Homo sapiens
  chr15:89952145-89952453
  hyper
tgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 1243 - DNA, 375 bp, Homo sapiens
  chr15:89952699-89953074
  hyper
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggatt

SEQ ID NO: 1244 - DNA, 114 bp, Homo sapiens
  chr16:2040847-2040961
  hyper
aacctctgggccagccgcacctcggcgcctgtcttggaggagggcggtgcccacggtggggcaggggctttggcctcccctgcggagtggctctgaccagaccgggaggcagga

SEQ ID NO: 1245 - DNA, 1 bp, Homo sapiens
  chr16:2040980-2040981
  hyper
c

SEQ ID NO: 1246 - DNA, 531 bp, Homo sapiens
  chr16:2040982-2041513
  hyper
cacgtcccgacttgtggcccactcttggggacaagtgcatgtcccggcttcccccttggctccactctcggagctggagcgggaaaggagcgaagggatgaggttgaggctggaggtcgtttcttggaaacacagggctgccccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcg

SEQ ID NO: 1247 - DNA, 619 bp, Homo sapiens
  chr16:2041581-2042200
  hyper
cggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacc

SEQ ID NO: 1248 - DNA, 560 bp, Homo sapiens
  chr16:3221141-3221701
  hyper
cgatgccagctctaggagcgtggccgggagcccacgatcgcggcagcgagaagcccaaccagaggggaggagggagtccccggagtgggacagcgctcaggtctggggtggggttgatctagggcaaaatagggcgggcggcctgtggcgatgggcaggaccctctcgcccaccacacgcggaactcgctggatcctctccacatccaggccgcgtccactggctttccaacctgctcaggtccttaaagaaggattcaaaaggtgttgcggtattggcccaacaggatttgaccctgaggcccactctcaccctaatcataaccgcaaaaccacagcgcctggagagagagtgagagagaaacagaaacggagcgagtgtgtgtcgctgtgatgccctttgccgtcgctgctcatccccagtgacctcctggaactttttcagctcttgctgacagaggaagacacgggggcagagctaacgtctgagtcagggcagaggcgctgggctccatccgagggaggctatgggggcgcctctgggatggagccaaccaccgg

SEQ ID NO: 1249 - DNA, 267 bp, Homo sapiens
  chr16:3221786-3222053
  hyper
cgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctc

SEQ ID NO: 1250 - DNA, 15 bp, Homo sapiens
  chr16:3222113-3222128
  hyper
cgagccctagaagtg

SEQ ID NO: 1251 - DNA, 376 bp, Homo sapiens
  chr16:3232641-3233017
  hyper
tccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 1252 - DNA, 133 bp, Homo sapiens
  chr16:3233198-3233331
  hyper
cgcttctcccgctccggtcctctcttctcccccagggaagccaaaacccagaaggtgagcttcccacgtggaacctcaattcaagaggctgacactgagcgtcgcttcgctccaccagacccgcggcgcccgc

SEQ ID NO: 1253 - DNA, 670 bp, Homo sapiens
  chr16:3233434-3234104
  hyper
cgtccaggtgtcggttccggggcaccttttactgtcactctgtccttctctgtgtccaaatttcacccggagcccgagaattcggcaggtctggactgaaaacgtctccccatcccctccggatccaagcctcgaatttcctggctcagtgggaaggcctcggggtctgggcgtggagacggggcccgagacccccaccccgccagggcccactaaagtgctgccagctgagccccggccttcgcccctccttcgtctctccctcattcccctccctctgacaccccgccacatacattactccccgcaataccatgcaattttaagctagggtagggctcacctgagactggagccgccataccgtcgaaccctacgaaaaatttatgcccgtaaataaacaagcccggcgcattcttccttattctaaataacttcttcctgctgcacggggtcgtctcctttaaccacggctaccgcagttggtagtgctggatcccatttcagggtgatgggatgctggatcccatttcagggtgataggaccgaccgcaaggcgaacgattcaggcccgtccgtctgcgtcccgggaccccgggaggtctccactgacgccctgccagcagcaggctccctccgccttcctagtctcctgtccttgctgaaaatg

SEQ ID NO: 1254 - DNA, 196 bp, Homo sapiens
  chr16:3234164-3234360
  hyper
cgcacccaaagcgagaatcatacccctagaccaacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagat

SEQ ID NO: 1255 - DNA, 164 bp, Homo sapiens
  chr16:3237900-3238064
  hyper
gagtaaagcctgcctcggaaatctgagggtggccgcgaacccacaagtcaagattcgcaggtgcgcgcgctaaggactgagctattggggcgatggagagagtctcgctctgcgtcagggacggaaggacgtgtcccccaccagaaaaaggaaaaaaaaaaaaa

SEQ ID NO: 1256 - DNA, 1500 bp, Homo sapiens
  chr16:3238124-3239624
  hyper
ttgggtgcgagaggtcccgggttcaaatcccggacgagcccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgt

SEQ ID NO: 1257 - DNA, 164 bp, Homo sapiens
  chr16:3239684-3239848
  hyper
gttcaaatcccggacgagcccggcttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccac

SEQ ID NO: 1258 - DNA, 143 bp, Homo sapiens
  chr16:22825327-22825470
  hyper
tgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcag

SEQ ID NO: 1259 - DNA, 216 bp, Homo sapiens
  chr16:23846838-23847054
  hyper
ggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccc

SEQ ID NO: 1260 - DNA, 15 bp, Homo sapiens
  chr16:23847310-23847325
  hyper
cggcagcagctgggc

SEQ ID NO: 1261 - DNA, 186 bp, Homo sapiens
  chr16:23847326-23847512
  hyper
agtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctg

SEQ ID NO: 1262 - DNA, 28 bp, Homo sapiens
  chr16:23847788-23847816
  hyper
ggactcccggctccggaccctgctgccc

SEQ ID NO: 1263 - DNA, 58 bp, Homo sapiens
  chr16:23847817-23847875
  hyper
ggactcccggatggacagtcctgccgttgccctgtccccaccctggtcccagacgggc

SEQ ID NO: 1264 - DNA, 70 bp, Homo sapiens
  chr16:23847933-23848003
  hyper
cggcgtcgcgggagcctttgctccacctgactaggagcgcgcggggtctgtgcctgccctggagggcagc

SEQ ID NO: 1265 - DNA, 68 bp, Homo sapiens
  chr16:23848004-23848072
  hyper
cctcgggtgctctccgacccggggttccctatctctccgcctgcttccgggcgcgaggagccctcgcc

SEQ ID NO: 1266 - DNA, 552 bp, Homo sapiens
  chr16:49315764-49316316
  hyper
caaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 1267 - DNA, 87 bp, Homo sapiens
  chr16:55363136-55363223
  hyper
ccctgcagggactaccgctgaactgtgcgccgtgcccgcggaggagcgagcctgtagtgcagtgccagtacccgtctggagcagaag

SEQ ID NO: 1268 - DNA, 610 bp, Homo sapiens
  chr16:56659128-56659738
  hyper
ctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtg

SEQ ID NO: 1269 - DNA, 30 bp, Homo sapiens
  chr16:56672513-56672543
  hyper
cgggtcctttgcgtccggccctctttcccc

SEQ ID NO: 1270 - DNA, 110 bp, Homo sapiens
  chr16:71459979-71460089
  hyper
ctccgccgcttgcaccggacccaggcgctcatcccccgcttcccccgcgccccagcccggtcacgcctcggagcttgtccccacctggccgtgctcagagtctgcctgcc

SEQ ID NO: 1271 - DNA, 81 bp, Homo sapiens
  chr16:71460270-71460351
  hyper
cgcacaagcccggggtgagaccagaagctgctgcctgcagagcccgaccttgcgtagatgactccgcgagtgcaaggggct

SEQ ID NO: 1272 - DNA, 56 bp, Homo sapiens
  chr16:86544502-86544558
  hyper
cccaagggccttgggcggcccggcaagggccactactggaccatcgacccggccag

SEQ ID NO: 1273 - DNA, 364 bp, Homo sapiens
  chr16:86599480-86599844
  hyper
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagt

SEQ ID NO: 1274 - DNA, 48 bp, Homo sapiens
  chr17:8868620-8868668
  hyper
ctgaggacacagctgcgcagagccgcccagcagaggttacccggataa

SEQ ID NO: 1275 - DNA, 399 bp, Homo sapiens
  chr17:8868814-8869213
  hyper
cggagcccactctccccgacggtccccagcttgctccagctctgcctggagctcccatgcgtgccctccgcatccgccctggccgcccagtcacacacctgcagtccccgccgggcgccgagcccctctccagcggcgactccctgcgattcgggtgaccgtcgggaccaccgcgccccagctggagccgcgcggcgagccgcagcatctgcccagcctgggctcctccggcgggcggggcggagcctgtcagggggcggggcctaatggggcggggctgaccgcggagccggcctctccagccacctggcggcccggcagcgtcagccaggtgcgcgcccggccccacatcctctgggtcacgcccccgaggccgcaaggcgtctgagaagcagcccc

SEQ ID NO: 1276 - DNA, 171 bp, Homo sapiens
  chr17:8869214-8869385
  hyper
gctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggca

SEQ ID NO: 1277 - DNA, 434 bp, Homo sapiens
  chr17:8907294-8907728
  hyper
ctcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 1278 - DNA, 22 bp, Homo sapiens
  chr17:8907776-8907798
  hyper
cgggtgacggaggctttatcct

SEQ ID NO: 1279 - DNA, 15 bp, Homo sapiens
  chr17:10101095-10101110
  hyper
actccggggtggaga

SEQ ID NO: 1280 - DNA, 317 bp, Homo sapiens
  chr17:10101131-10101448
  hyper
cggtgccactttctcgcacccctgatcctccgtgcctcttcccaagaccgccagacccttcaccggcccctgccactgccgggaacgctcccgcctgctccttaactcacacaggcaacaagttctcgcttcctcagagcagccacggtgtgctccggaggcccggcgcaaggtggaagctccccgcgagtccgcgttgcccacgccccgaggggcgcccgctgccgtcgctgccccccaggagcgtggagctacaggtagcgccggcaagggctgccccccggggcgcccctccgaccgggacgctgcggcatccc

SEQ ID NO: 1281 - DNA, 118 bp, Homo sapiens
  chr17:31618291-31618409
  hyper
gttctgccttggcatcgtggagtggtaacactgcaagaggcctggggacagccccgagggggcggaacaccaggcctcctgactgccggggagtggggcgcagagggagcgggttcgc

SEQ ID NO: 1282 - DNA, 344 bp, Homo sapiens
  chr17:31618410-31618754
  hyper
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaact

SEQ ID NO: 1283 - DNA, 228 bp, Homo sapiens
  chr17:35297936-35298164
  hyper
cggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcc

SEQ ID NO: 1284 - DNA, 259 bp, Homo sapiens
  chr17:35299185-35299444
  hyper
acagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccc

SEQ ID NO: 1285 - DNA, 89 bp, Homo sapiens
  chr17:35299600-35299689
  hyper
gctggtggaccgcctggagccgggcgagctcatccccaatggtcccttctccttctacggaggtgggtgcgcgccgaatggcggggcac

SEQ ID NO: 1286 - DNA, 56 bp, Homo sapiens
  chr17:35299910-35299966
  hyper
cccgcgagggctccccgcgatccgcgagttccccgcgtggccttcctcagcccgcc

SEQ ID NO: 1287 - DNA, 453 bp, Homo sapiens
  chr17:35300260-35300713
  hyper
ggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatc

SEQ ID NO: 1288 - DNA, 30 bp, Homo sapiens
  chr17:35300812-35300842
  hyper
cgtggggagggaggccgtgagcacagccgg

SEQ ID NO: 1289 - DNA, 210 bp, Homo sapiens
  chr17:35303325-35303535
  hyper
acaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctag

SEQ ID NO: 1290 - DNA, 423 bp, Homo sapiens
  chr17:37381007-37381430
  hyper
gcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggc

SEQ ID NO: 1291 - DNA, 157 bp, Homo sapiens
  chr17:37381570-37381727
  hyper
cgcgaccctaggacgcccgggcccacaggaggaccccgccgggaagagggcgcccgggcccggggcgcggacaggccttgcgccccccaagttaccttggtttcctggagggcggagacggtccctggggggctgtgggtggccgcgtcatccggtt

SEQ ID NO: 1292 - DNA, 292 bp, Homo sapiens
  chr17:37381825-37382117
  hyper
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccg

SEQ ID NO: 1293 - DNA, 466 bp, Homo sapiens
  chr17:42635294-42635760
  hyper
tgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 1294 - DNA, 96 bp, Homo sapiens
  chr17:43047752-43047848
  hyper
cgcagagccctccgggcacaccgcggctggccgcccggggccaaggatggggcgggagcgcccacccacccccgcgccggccggggcatccaagag

SEQ ID NO: 1295 - DNA, 324 bp, Homo sapiens
  chr17:46655070-46655394
  hyper
ctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 1296 - DNA, 24 bp, Homo sapiens
  chr17:46655395-46655419
  hyper
gcgcaggagcccgaggggacagac

SEQ ID NO: 1297 - DNA, 111 bp, Homo sapiens
  chr17:46655450-46655561
  hyper
cggaggcggcgggggcccagggtcccggcaggccgcgtagcgctgcacggtgcacgccgcgcgccgcccgaagcccgcctccggctggaagctgctctctcgcctctggcc

SEQ ID NO: 1298 - DNA, 437 bp, Homo sapiens
  chr17:46655562-46655999
  hyper
ccggcgtagtacccgggcgagtggtcgctgggtaggtaatcgctctgtgaatattcctcgcatggagggaacttggggtcgacatagtttgagttgatcaaaaaagaactcatagccattaatttctgggaattgcccacaaaatatactaaaatttattccgacccctgactcgttttcctgtttccgaaagccctcctacttactgtcaagtgaacaaagttaggcgcccacgtgatcctccgagccaatggccgccccgcctgcgattcccggataaggaaatctgctcacccggaccccactccagccaaagaggtttatttccccttcttcccttccccctccccacccacccacccaacaccaggatttacatagggctcctgcggggcgaccccctccttgcctcgctctctccgggatcagagagagag

SEQ ID NO: 1299 - DNA, 341 bp, Homo sapiens
  chr17:46656057-46656398
  hyper
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgatag

SEQ ID NO: 1300 - DNA, 938 bp, Homo sapiens
  chr17:46795436-46796374
  hyper
ctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcc

SEQ ID NO: 1301 - DNA, 55 bp, Homo sapiens
  chr17:46796498-46796553
  hyper
ggagatcgagtgtttgatcttcccttgctccaggatcctgaattctttaaacaca

SEQ ID NO: 1302 - DNA, 25 bp, Homo sapiens
  chr17:46796613-46796638
  hyper
cagcactactaccgtctgagcaggc

SEQ ID NO: 1303 - DNA, 606 bp, Homo sapiens
  chr17:46802306-46802912
  hyper
tccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 1304 - DNA, 117 bp, Homo sapiens
  chr17:46802993-46803110
  hyper
cgtggagaatgcgccggcaggccccccacccccagcctaaggtgcaggaaggaccagcacgaacccgctggctttgctgcgcggccaggagatgagtcccaccgggcactgagccca

SEQ ID NO: 1305 - DNA, 318 bp, Homo sapiens
  chr17:46804107-46804425
  hyper
ggacacccccactttcgctcctcccacccaggcaaggagatctcttaaggggtagcgctgttcttcaccttggcgagaaccttcttctctttgacccggcggttctgaaaccagatggtaatctggcgctccgagaggctggtggctgccgagatcttgcgcctcttgtccttggtgatgaacttgttagccgcatactcccgctccagctcccgcaactgccccttgctgtacggaatgcgtttcttgcggccgcgacgaaaggcgcaggcgtcaggagggtgctgcccgctggagtctgcgcggcgtgaaagggag

SEQ ID NO: 1306 - DNA, 347 bp, Homo sapiens
  chr17:46824568-46824915
  hyper
attcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 1307 - DNA, 469 bp, Homo sapiens
  chr17:46824916-46825385
  hyper
gcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggag

SEQ ID NO: 1308 - DNA, 502 bp, Homo sapiens
  chr17:46831824-46832326
  hyper
agcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 1309 - DNA, 150 bp, Homo sapiens
  chr17:46832489-46832639
  hyper
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctc

SEQ ID NO: 1310 - DNA, 177 bp, Homo sapiens
  chr17:47075225-47075402
  hyper
ccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctcc

SEQ ID NO: 1311 - DNA, 239 bp, Homo sapiens
  chr17:48042409-48042648
  hyper
aactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctaggg

SEQ ID NO: 1312 - DNA, 206 bp, Homo sapiens
  chr17:48042750-48042956
  hyper
cggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctag

SEQ ID NO: 1313 - DNA, 1027 bp, Homo sapiens
  chr17:48049499-48050526
  hyper
agaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctact

SEQ ID NO: 1314 - DNA, 414 bp, Homo sapiens
  chr17:59478133-59478547
  hyper
aacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccga

SEQ ID NO: 1315 - DNA, 275 bp, Homo sapiens
  chr17:59528876-59529151
  hyper
atctcaaggagctgccgcggaatcctggccctgggccgcagtttccccaggaggctctgccaagcctggcaccttgcagcccggcctgggctctgtcaaggcccgagccggactcggctccactcagaggccggcccagcacttccctgccgccgccgccccgcacccggccaccgggcttcctcccagtcctcacccctgacctccgcggccgacttcgaggcgcgccaggccgggtccagcgcccgcggccccctgggccgggacaaggaggg

SEQ ID NO: 1316 - DNA, 12 bp, Homo sapiens
  chr17:59529253-59529265
  hyper
cgacctcgggac

SEQ ID NO: 1317 - DNA, 233 bp, Homo sapiens
  chr17:59529843-59530076
  hyper
cggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttca

SEQ ID NO: 1318 - DNA, 170 bp, Homo sapiens
  chr17:59533874-59534044
  hyper
cgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggc

SEQ ID NO: 1319 - DNA, 66 bp, Homo sapiens
  chr17:59534340-59534406
  hyper
ccagctccaacaacccgtagagggcctgggacccaacggcgagggggcaggaggaggccaccccgc

SEQ ID NO: 1320 - DNA, 225 bp, Homo sapiens
  chr17:59534556-59534781
  hyper
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagcca

SEQ ID NO: 1321 - DNA, 21 bp, Homo sapiens
  chr17:70113546-70113567
  hyper
cttccacaagaaactcgtgtc

SEQ ID NO: 1322 - DNA, 372 bp, Homo sapiens
  chr17:70113647-70114019
  hyper
cggggacctgtccctccagggataggagtcttctacctgcaagggacccggcctggggaactggaatagacaaggggtaaccccttctcccatcacctctaatgagaacattgtccggggctgagatatttgggggacgccgctgctcaccccaccaaactttccctagggacagaaaagcgtccctaccgaaaacggatttaaacaccgtccccacttttgctaaggaagtttggatagggaggttgtggtccttaattcgccaggtaaaaggaaccccatcagctcgcatccctcacccccatcctgagcactgagtgtttgcgagaaactcgccctgcgccagcaactctgggctccggtctcagctcc

SEQ ID NO: 1323 - DNA, 365 bp, Homo sapiens
  chr17:70114152-70114517
  hyper
cgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctg

SEQ ID NO: 1324 - DNA, 640 bp, Homo sapiens
  chr17:70215667-70216307
  hyper
ccagggcagcagacacgctctcccaaaggggcggacacagacgtcctcacaccgcggcccgaccggccgcacattaatccgggtggatttggccatcttgtgacatagccaatcagttcgagggaggggacggcaggaacgcctctcctttcacgccacaaaaggattttcgtcccttgagagcacaatgaaaaaaaaaaaaaaaaaaagccaatcaaggcgggatcagctgtgggctggtcgctgcagatctgtctctcccagaggggggtgggggcacatattggtccgtgtgggaaacccagagcctcagcttctcacacattgttctcctcctcttcaactgcaccccctccccaccagcccggaccctcccctctcccctccccaaagccgttattgccacaaaagatactttccccattgtgccccggacagctgagaggtccgagttagccatacacagctccgcgtcctctccagggagaaaggggatggaccctgcaagtggagagcgggatgcttatcatacaaaggaattaaacccacttgggctctctcgccatccaggactgtggggggttaaatacggttacattttcattaggtgctaatagcagaagggcagccccgggcagca

SEQ ID NO: 1325 - DNA, 54 bp, Homo sapiens
  chr17:70216392-70216446
  hyper
cgtcaaagccgggtccagggaaggggggcatgccatgggcgtattgttggcctg

SEQ ID NO: 1326 - DNA, 38 bp, Homo sapiens
  chr17:74072998-74073036
  hyper
cgtcgacccggtggccgcgggctcgggtgcccggcgcg

SEQ ID NO: 1327 - DNA, 18 bp, Homo sapiens
  chr17:75369440-75369458
  hyper
gcctaggggctcctccgg

SEQ ID NO: 1328 - DNA, 228 bp, Homo sapiens
  chr17:75369492-75369720
  hyper
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgag

SEQ ID NO: 1329 - DNA, 324 bp, Homo sapiens
  chr18:12307602-12307926
  hyper
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcgg

SEQ ID NO: 1330 - DNA, 350 bp, Homo sapiens
  chr18:13868570-13868920
  hyper
gtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggcagctttgaaaacaagcgcaaggagatgcatccaaaagacaaccgaacccatcagggtaaggagcgcagcggtggagtgtgagggggaaccagaagggcggccagggccggcggcatgccatgccaggcagccccgcgccaccccggaacactgggacactctcatattcccaaagggacttctccatgcggcgctctgaccaggcat

SEQ ID NO: 1331 - DNA, 526 bp, Homo sapiens
  chr18:31739116-31739642
  hyper
tggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 1332 - DNA, 262 bp, Homo sapiens
  chr18:44336188-44336450
  hyper
tggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggc

SEQ ID NO: 1333 - DNA, 164 bp, Homo sapiens
  chr18:44337012-44337176
  hyper
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcgcggtggctcactcctgtaatcccag

SEQ ID NO: 1334 - DNA, 202 bp, Homo sapiens
  chr18:44337416-44337618
  hyper
agactccgtctcaaaaagaaaaaaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaagga

SEQ ID NO: 1335 - DNA, 193 bp, Homo sapiens
  chr18:44337649-44337842
  hyper
cggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagc

SEQ ID NO: 1336 - DNA, 140 bp, Homo sapiens
  chr18:44772977-44773117
  hyper
gtgaactgggctgcccgggctgctgctgccgccgccactcgccttctggggggccaggggcggcggcgggggcgggggcaggtccgagccggggtccccgagtttcccgtcttcctgcagcagcctggaggagttcaggc

SEQ ID NO: 1337 - DNA, 501 bp, Homo sapiens
  chr18:44773466-44773967
  hyper
cggcggggccgggtggtggcgctcggaacccggctcgtcgggctgcgggggcagcagcagaagcggcgacggcggctgcggggggtggtggtggtggtggtggtggtgagggtggtgatggtggtggggatgcgtctgggccgagtggggcgcgcccgccgacgccccgtgcagcttggccaggctctccgcgtcgtccttgccgcccactggccggaaggcgctggaatggtggtagctgccaccgcccgctttgcgcccctccagaaggtgcggatggtggggcgccggaacccgggagcccgcggggccagacccggcggccgcggcccctgccccggcagctgccacagagtccgcgggcggcgtggagcccgcgctgcagtccccgccgctgccgcccgggggcgactcgaagagcgcgtcgcgagagccggcgcccccggcaggaggaggtgggccggagcccgggccgttggccactacctgcgggggctgccc

SEQ ID NO: 1338 - DNA, 609 bp, Homo sapiens
  chr18:53446866-53447475
  hyper
aaatgccaggagccccgggggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggc

SEQ ID NO: 1339 - DNA, 57 bp, Homo sapiens
  chr18:53447798-53447855
  hyper
cgccggctactcagctggccccgcagcttccctgcggctcagcggcctcccacccag

SEQ ID NO: 1340 - DNA, 154 bp, Homo sapiens
  chr18:56939498-56939652
  hyper
aaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtc

SEQ ID NO: 1341 - DNA, 408 bp, Homo sapiens
  chr18:56939763-56940171
  hyper
cgcttcgccggtggctggcccgacgggcagccctgggctcggccgtgcctccccgggctccttggggcagtagggtcgaggggctggggcgacgaggcccgggagggtcagatgcactccccaaaacacccttgggccgaccccgcctcgctgtgggcactggccagcccgcctgcgggctccgagatggcccggggaggtccgtggtgagggcggcgatgggtcctaagctttctctgaatgcaaattggaagctcccgccatagacggtccccaaccccgcgcccagttgccttaataaaagttaaggaaggggcgctctcgtctggccaactcctaagctcgggcgcccgaacggcctcgcacagccaggggtgcgcactcaccttcgtactcgggggcgggcgc

SEQ ID NO: 1342 - DNA, 680 bp, Homo sapiens
  chr18:56940565-56941245
  hyper
gcccgggctgcgcacgctgggggtggccgagcgctcagcccgctgccgccttagtcccagaagtcggaagttcgggctcggggtagctggggctctcggcgctaaaggcggggagccaactggccctcggctcctcccctctcgccctggacccagccccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggctcatctctccccttgcgtttgtctccctctacttcgggcttaccctctcacttcagactaccccctgggggtcacctccctccttggacgcacccctccccagcttcagactcgcccctctagccccctctggctcacctccgcggggccgccaccctggcctgtgccccctggaagcgccgagacccagccgaaggcttcccagccccgcactcgtcgcagtttgaatttcccctcgctggctcccttttcgggacccactcctttcttggctgggttgtacgaagtcc

SEQ ID NO: 1343 - DNA, 240 bp, Homo sapiens
  chr18:56941557-56941797
  hyper
gggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaa

SEQ ID NO: 1344 - DNA, 182 bp, Homo sapiens
  chr18:70535373-70535555
  hyper
tggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatc

SEQ ID NO: 1345 - DNA, 80 bp, Homo sapiens
  chr18:70535575-70535655
  hyper
cgcagagagaggatgcagccgcaaatcccgagccggatcctcgtgccggacggaaggcgtggaagcgggaggggccttcg

SEQ ID NO: 1346 - DNA, 78 bp, Homo sapiens
  chr18:77547970-77548048
  hyper
ccgggggaggcgggacgcaggcgaaggccgccccgggagagcggggtcccgggagagcggggtcccggctgtggggga

SEQ ID NO: 1347 - DNA, 258 bp, Homo sapiens
  chr18:77548351-77548609
  hyper
ggcaggcccagctcggacgaggctcagctgccgcccccgttgcctttgtgggtttttctgcggaagccccttttcctcgggtggatgggaccctgcgcgtggaaccccgcacagcccccgctccgccgcgggccgcaggacccattccttctccacggtggcgctggggaggggctgcttccacccaggagattcgcgagggagagaaaacatgcggctcacatccggacggcagccccgccccgcttagaaacaata

SEQ ID NO: 1348 - DNA, 415 bp, Homo sapiens
  chr18:77557982-77558397
  hyper
ggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagc

SEQ ID NO: 1349 - DNA, 726 bp, Homo sapiens
  chr18:77558416-77559142
  hyper
cgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaa

SEQ ID NO: 1350 - DNA, 199 bp, Homo sapiens
  chr19:3785637-3785836
  hyper
gaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccact

SEQ ID NO: 1351 - DNA, 357 bp, Homo sapiens
  chr19:3785864-3786221
  hyper
cgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctcc

SEQ ID NO: 1352 - DNA, 16 bp, Homo sapiens
  chr19:3786583-3786599
  hyper
gcgcggcggggaccgg

SEQ ID NO: 1353 - DNA, 141 bp, Homo sapiens
  chr19:6590370-6590511
  hyper
aacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggcc

SEQ ID NO: 1354 - DNA, 118 bp, Homo sapiens
  chr19:9473938-9474056
  hyper
ccattccgggcattggttcccgggaggaggcaagtgggttcatgtggtcagagtgcgtcggcggggccttttctccactttctgtacccttctctttaaacgtcgtccccagtaggag

SEQ ID NO: 1355 - DNA, 4 bp, Homo sapiens
  chr19:10624849-10624853
  hyper
gcgc

SEQ ID NO: 1356 - DNA, 443 bp, Homo sapiens
  chr19:10624965-10625408
  hyper
cgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtag

SEQ ID NO: 1357 - DNA, 336 bp, Homo sapiens
  chr19:12203013-12203349
  hyper
tcagggctctgaaggcgaggcggggagcacggtccaatcaggagcgccggggcggggccctgccaacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggtgagtgtgtggggccaggcgtcctgagacgggggcgaagggcttcttagaacctgctggaacc

SEQ ID NO: 1358 - DNA, 343 bp, Homo sapiens
  chr19:12203350-12203693
  hyper
gctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatggccgggcgcggtggctcacctgaggtcaggagttcgagaccaacctaacatggaga

SEQ ID NO: 1359 - DNA, 261 bp, Homo sapiens
  chr19:13616696-13616957
  hyper
gggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctcc

SEQ ID NO: 1360 - DNA, 307 bp, Homo sapiens
  chr19:13617158-13617465
  hyper
cgactgcggagacgctccacggcccagcccatcgggcggcggcggctcggcgcctcgggtcgggggctcagaaggcggctgcccgggccgagccggggatagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaa

SEQ ID NO: 1361 - DNA, 29 bp, Homo sapiens
  chr19:13617489-13617518
  hyper
cggtttgcaaaggacgccccccccgggac

SEQ ID NO: 1362 - DNA, 138 bp, Homo sapiens
  chr19:17007251-17007389
  hyper
gggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctggg

SEQ ID NO: 1363 - DNA, 347 bp, Homo sapiens
  chr19:17007446-17007793
  hyper
cggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 1364 - DNA, 256 bp, Homo sapiens
  chr19:23257752-23258008
  hyper
gcctctcaaagtgctgggatcacaggcgtgagccaccgccccccgacgcctcagctcatttgttaattagcagtaattgcccgggtcagtgacacctcctacttgagcctctttccctgtccataaaatgcactaatactggggtgggtgggattgggaggtgggtcctggagctccatccaatcagtggcactggtgtaggaaccgcccgatcaggcgcgcagttggagaggagggcgtggcttccggcatttgg

SEQ ID NO: 1365 - DNA, 287 bp, Homo sapiens
  chr19:23258305-23258592
  hyper
cggccccaggcgtctctggccgcaagatggcggctgggcccgcggccgggacccccagcgtctcgccgcgtccctgctgggcgccctgtctggacctccctgggcagctctgcgcccgcagccccgagtatttcccagagtgcttagggatgccaggcgggtcatcagggtagaatcccgactaggtgtgtgcgtgggaggagctgcgacccgtggggttcccaagctttcctgttattttttttttcttttctttttagacagtctcgctctgtcgctaaggtaaa

SEQ ID NO: 1366 - DNA, 79 bp, Homo sapiens
  chr19:23258652-23258731
  hyper
tgccgggattacagggttgagccaccgcgcctggcctaatatattaatttataagaaatgcattcgagttgggttttag

SEQ ID NO: 1367 - DNA, 391 bp, Homo sapiens
  chr19:30015572-30015963
  hyper
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggact

SEQ ID NO: 1368 - DNA, 724 bp, Homo sapiens
  chr19:30016024-30016748
  hyper
cggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccga

SEQ ID NO: 1369 - DNA, 59 bp, Homo sapiens
  chr19:30017451-30017510
  hyper
gctcccgggcccccgccgccaccgcgccccccgcgggagatggaacagcggaaccggct

SEQ ID NO: 1370 - DNA, 145 bp, Homo sapiens
  chr19:30017577-30017722
  hyper
cgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagagg

SEQ ID NO: 1371 - DNA, 967 bp, Homo sapiens
  chr19:30017765-30018732
  hyper
cgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagc

SEQ ID NO: 1372 - DNA, 416 bp, Homo sapiens
  chr19:30019113-30019529
  hyper
accagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggc

SEQ ID NO: 1373 - DNA, 81 bp, Homo sapiens
  chr19:30019530-30019611
  hyper
ccatctgtcgccggttgcagggtcgggttctcttttgtgtaaatcaagggtccaaggcttgagtcccctaattcggctcgg

SEQ ID NO: 1374 - DNA, 252 bp, Homo sapiens
  chr19:30019660-30019912
  hyper
cgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttg

SEQ ID NO: 1375 - DNA, 457 bp, Homo sapiens
  chr19:30716313-30716770
  hyper
atgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 1376 - DNA, 779 bp, Homo sapiens
  chr19:30716952-30717731
  hyper
cgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaaga

SEQ ID NO: 1377 - DNA, 756 bp, Homo sapiens
  chr19:30719283-30720039
  hyper
tagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgt

SEQ ID NO: 1378 - DNA, 280 bp, Homo sapiens
  chr19:36909069-36909349
  hyper
tcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgagg

SEQ ID NO: 1379 - DNA, 244 bp, Homo sapiens
  chr19:36909623-36909867
  hyper
cgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtggga

SEQ ID NO: 1380 - DNA, 171 bp, Homo sapiens
  chr19:37264222-37264393
  hyper
gctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagat

SEQ ID NO: 1381 - DNA, 25 bp, Homo sapiens
  chr19:37287936-37287961
  hyper
tttgttttttgaaaccgagtttcgc

SEQ ID NO: 1382 - DNA, 224 bp, Homo sapiens
  chr19:37288201-37288425
  hyper
acaggcgtgagccgccgcgctcggccggccccaaacacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccc

SEQ ID NO: 1383 - DNA, 99 bp, Homo sapiens
  chr19:37288606-37288705
  hyper
cgggctgcgtcccggcccttccacatcggtccaccgcactcgtgggcgcccgcattggtgctgacataatttcctgacctctgacccgtattgtctcgc

SEQ ID NO: 1384 - DNA, 59 bp, Homo sapiens
  chr19:37288706-37288765
  hyper
attaaaggtaaaaaacggggctttttcatcccactggggtaaaacgcccttttatttct

SEQ ID NO: 1385 - DNA, 71 bp, Homo sapiens
  chr19:37407081-37407152
  hyper
catccagccgagcctcggagttgcgggtcgccgtagcgctgcgcaatggagatgagcctcccggggaaccc

SEQ ID NO: 1386 - DNA, 221 bp, Homo sapiens
  chr19:37407153-37407374
  hyper
gcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgac

SEQ ID NO: 1387 - DNA, 68 bp, Homo sapiens
  chr19:37407375-37407443
  hyper
ctgccgagtccccgcagcagggggcgagcaagggactcgcggttgacgggacacggatcctctaaggc

SEQ ID NO: 1388 - DNA, 347 bp, Homo sapiens
  chr19:39754886-39755233
  hyper
aggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacc

SEQ ID NO: 1389 - DNA, 156 bp, Homo sapiens
  chr19:39755264-39755420
  hyper
cgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccg

SEQ ID NO: 1390 - DNA, 616 bp, Homo sapiens
  chr19:45655778-45656394
  hyper
tgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctcca

SEQ ID NO: 1391 - DNA, 361 bp, Homo sapiens
  chr19:45888864-45889225
  hyper
cgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcac

SEQ ID NO: 1392 - DNA, 82 bp, Homo sapiens
  chr19:45889315-45889397
  hyper
cgcctgctgcaccacctccagctccccggtcagcgccgcgtccaggaggagcaccagagggttgaggcgcgcgcggcgggcc

SEQ ID NO: 1393 - DNA, 78 bp, Homo sapiens
  chr19:48918201-48918279
  hyper
catcggcttcagctacgacctctacctggtcaccaatggcaagcacggaaagaagatcgatggcgtctggaacggcat

SEQ ID NO: 1394 - DNA, 114 bp, Homo sapiens
  chr19:51830889-51831003
  hyper
agaatgctgggtcaccggggaacggaggagcctgagagtcggggggctggcctggctgggcgctgcggcccggcccctgacccggatccctggcaggctgagcagcggcacggc

SEQ ID NO: 1395 - DNA, 270 bp, Homo sapiens
  chr19:51831120-51831390
  hyper
cgcctccatgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaacaaggtttggggattcgcagagcttatagt

SEQ ID NO: 1396 - DNA, 197 bp, Homo sapiens
  chr19:54481771-54481968
  hyper
ctggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 1397 - DNA, 77 bp, Homo sapiens
  chr19:54483391-54483468
  hyper
tgccccgagcacccccgggggcccggagccttcctaggcggtccccaagctccatcgccacccgctgggtaaggtgg

SEQ ID NO: 1398 - DNA, 53 bp, Homo sapiens
  chr19:56879501-56879554
  hyper
gtactcagtcaccagcggaaccctctccaccaggctccgcgtcgaggccctac

SEQ ID NO: 1399 - DNA, 90 bp, Homo sapiens
  chr19:56879555-56879645
  hyper
gggcgtcaatacgcacgcgtactttgtgtcccaggtagctcgtctcttagccatgtacgcctctgcattccggtcactgggagcggggcc

SEQ ID NO: 1400 - DNA, 322 bp, Homo sapiens
  chr19:56879646-56879968
  hyper
tgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaag

SEQ ID NO: 1401 - DNA, 193 bp, Homo sapiens
  chr19:56904511-56904704
  hyper
aaaaaaaaaaaggcacgcataacagtgaatgcaaaacatccgcaatttcagggggtcggagacccctgcgcacccacctaaggggtccatgcacctgggctatgaggctggaagcagaaagggggcgccagaaagcgcacgccgcgagggccggcgggaaatgtagtctcacgccggtaaagccacagagcga

SEQ ID NO: 1402 - DNA, 274 bp, Homo sapiens
  chr19:56904723-56904997
  hyper
cgttcttctcaggcctgagacccaaccggcccgggcaccagctcctgctggaccccagagcgcctggaaagctccggaacctctcacctgccgcctcctcgggtccaagtgccaccgcggccgcgcccccggcagcccagggcgcgcttccaccacggtaccggtggattcgccgtgcgcagccggaagatggcgcagacgcacaaagcacaccgatgctgcgccatgatagggccggcgccgcagtgtcttccgggaaacatagtctttaggc

SEQ ID NO: 1403 - DNA, 50 bp, Homo sapiens
  chr19:56904998-56905048
  hyper
taaaggcagcagcccggccttgaagccggatctcgcgatgtttcagggtg

SEQ ID NO: 1404 - DNA, 183 bp, Homo sapiens
  chr19:57182944-57183127
  hyper
gttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggc

SEQ ID NO: 1405 - DNA, 480 bp, Homo sapiens
  chr19:58094988-58095468
  hyper
ccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttcc

SEQ ID NO: 1406 - DNA, 308 bp, Homo sapiens
  chr19:58095469-58095777
  hyper
ctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgg

SEQ ID NO: 1407 - DNA, 467 bp, Homo sapiens
  chr19:58219926-58220393
  hyper
gcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcagactctgcgggtagagctgggccgggagcgacgggcgacattggtagggacc

SEQ ID NO: 1408 - DNA, 217 bp, Homo sapiens
  chr19:58220515-58220732
  hyper
cgctctgctatctctgatccggtgaacacacctcagagaagctaaaatggccgccacgaagaggcccccccaaaagtcccgtcctttctttttgtgactctcaaggaaagtcggttttctgagctcttactggcttagtagcgtggcgttcaacgcagagcattctaggtaatgtagttttcatagatcccgaggtgggtgccggggaccctttgca

SEQ ID NO: 1409 - DNA, 413 bp, Homo sapiens
  chr19:58238326-58238739
  hyper
cagtagcctccttaccggtctcctcgtatccatcctcgcagtccccaccccaaactaatgttctcccctgagcaaatttcgagacacttaaaatcccagctaagatcacgtccttctattcaaaaccctcagttaatctcaacgccctcagaatgaagcgacaacttctcagcctgccattccagtcacagttcctcaaactctgctctgtgttgatgagaaccctgtctcccaaatgtttgggggtcagcagcacccccgagcctttacctgcgccgtcccctccgcccgtaactctcccacacccacccacaccgagataggaccccgccccaagagtgcgtcgctgtcctgggacacaggggctgcaggcactttacgattcggagtcggagaaagggtgactgagggcc

SEQ ID NO: 1410 - DNA, 25 bp, Homo sapiens
  chr19:58238987-58239012
  hyper
gctacaaggaggagccggaagtccc

SEQ ID NO: 1411 - DNA, 188 bp, Homo sapiens
  chr19:58239013-58239201
  hyper
cccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaacccgagttt

SEQ ID NO: 1412 - DNA, 112 bp, Homo sapiens
  chr19:58400406-58400518
  hyper
gccgccaccagagggcgccggaagtccggacccattgtcacgtgcacacaggaaacgcctttattctgagccctcagaggtcttctacgctatcattcgaggctgagttttc

SEQ ID NO: 1413 - DNA, 74 bp, Homo sapiens
  chr19:58951525-58951599
  hyper
cgccggaagtcccgcctctcaatgacagctcggacttgccactggtccgagctttcattggctcaaggatcccc

SEQ ID NO: 1414 - DNA, 178 bp, Homo sapiens
  chr19:58951600-58951778
  hyper
ccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggc

SEQ ID NO: 1415 - DNA, 279 bp, Homo sapiens
  chr19:58951779-58952058
  hyper
gagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccc

SEQ ID NO: 1416 - DNA, 28 bp, Homo sapiens
  chr20:291135-291163
  hyper
cgttgccatagaaaccggccgcacaggc

SEQ ID NO: 1417 - DNA, 153 bp, Homo sapiens
  chr20:291220-291373
  hyper
cgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttt

SEQ ID NO: 1418 - DNA, 274 bp, Homo sapiens
  chr20:644552-644826
  hyper
ccctgcagcagccagggccgcgagaaggccttgccgcagacgccgcacttgtggcgcaggttgtgcgtgagcaggtgcatggcgagcgcgggcatggacacgtaggccttgccgcacgtcgggcatttgcgcgccagctggctgtccaggctgcggtgcgtctgcttgtggcggctcaggttcgacgacgtggcgtaggtcttgccgcactcggcgcacgcgtgccggtgcccgccgcccgcctgcgcccccgcgcgccccgcgcgccccccgg

SEQ ID NO: 1419 - DNA, 320 bp, Homo sapiens
  chr20:644985-645305
  hyper
cggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatag

SEQ ID NO: 1420 - DNA, 219 bp, Homo sapiens
  chr20:2780903-2781122
  hyper
agtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtccc

SEQ ID NO: 1421 - DNA, 589 bp, Homo sapiens
  chr20:2781123-2781712
  hyper
ggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattg

SEQ ID NO: 1422 - DNA, 152 bp, Homo sapiens
  chr20:3052540-3052692
  hyper
gcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgcccc

SEQ ID NO: 1423 - DNA, 380 bp, Homo sapiens
  chr20:3052693-3053073
  hyper
gctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatg

SEQ ID NO: 1424 - DNA, 205 bp, Homo sapiens
  chr20:9489503-9489708
  hyper
acttttatcacccatcgctatacccagagcagctgctcgaatgtgccaaggagcccaactcgggtgcaaagcgccgacgtctttcccaggttgaggacatcgcgagccagaggtgcaggcagcgaggcgcccaacagtagaatgcatcttccttcccgcgggcagaagccgtcaagtctggagtccgcagcgggcgcgcgggcca

SEQ ID NO: 1425 - DNA, 10 bp, Homo sapiens
  chr20:20346166-20346176
  hyper
gggtggtgaa

SEQ ID NO: 1426 - DNA, 377 bp, Homo sapiens
  chr20:20347333-20347710
  hyper
gggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgca

SEQ ID NO: 1427 - DNA, 486 bp, Homo sapiens
  chr20:20347736-20348222
  hyper
cggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccc

SEQ ID NO: 1428 - DNA, 26 bp, Homo sapiens
  chr20:20348257-20348283
  hyper
cggctccggctcgcggattgaaccct

SEQ ID NO: 1429 - DNA, 281 bp, Homo sapiens
  chr20:21080676-21080957
  hyper
gcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagc

SEQ ID NO: 1430 - DNA, 817 bp, Homo sapiens
  chr20:21081028-21081845
  hyper
cgttagcccggggtttcaccgaagccggcgattcgaagggagtggcgtttccgcaaactgcatcgctaggggcccggcgtggaagcgcctctgcgcaactttcctccaccgctgcctacaagggaggctctggcttccgtttacttattttttaggagttttaacctttggttcctgcttttacaaccgctaaccccaaaaacattttttttttctttttgttctttgtaaaaccaaaccactatgctgtgcgttcatgttcaactctgttgaaatcccgggtgggccgaaataagatttaattgtctcctgcgtggagaagtgacacccactttttcccctgaattgagcaaacaccagggctttgtctgagcttgtggcttaaacgccgggcggtttctgcacccagttggtgggttgtaagacaggaggtttccaagtctttcatcatgtttctaacaaggaaaaccaaatcgggcccataatgtcatcagccccggcccgacctcgccgggacctcggcagcccgatgatgtcgctagcggccccggcgcagccacgacgcgccgcctttcagctcctcgcagtccccacaaaagccagacaacaatatcaattaatcatgcagcgggcaaacaaggagatttatcccgcgacaaacagccccaccgagagccgctgaatgggcgtgattagcatgtgaaaaggcgagcaaaactccgcggttcaacagctaaagagcaatttgatggggctgggatggggaaattacttgattagcgtccatcggaggagaacacggttacagcccctcggc

SEQ ID NO: 1431 - DNA, 30 bp, Homo sapiens
  chr20:21082094-21082124
  hyper
ggctctggcccggaaagagagtgacagagg

SEQ ID NO: 1432 - DNA, 741 bp, Homo sapiens
  chr20:21082215-21082956
  hyper
cgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagaga

SEQ ID NO: 1433 - DNA, 170 bp, Homo sapiens
  chr20:21086917-21087087
  hyper
aaggcgcagacccaccgctcgccaagcctcgccccgcactgtgcacgggaagagggggctccgcgcgcagcccagtccggttagctggtcggcgtcggcggggctgccgaggtggcgcagagctcccctcccccacgccttataatttaatcacacgcgatattaaatta

SEQ ID NO: 1434 - DNA, 15 bp, Homo sapiens
  chr20:21372178-21372193
  hyper
gatggtggcggcgcc

SEQ ID NO: 1435 - DNA, 200 bp, Homo sapiens
  chr20:21372294-21372494
  hyper
cgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaact

SEQ ID NO: 1436 - DNA, 130 bp, Homo sapiens
  chr20:21376207-21376337
  hyper
ttttatagttacaaacgccaacaaagtttccaactttgagagctgtagttaagaatgccgtgtgaacttctccaccttttcgcgtcatttaagaacttctaggaggagaaaatcaccacctcaaagcctc

SEQ ID NO: 1437 - DNA, 32 bp, Homo sapiens
  chr20:21376702-21376734
  hyper
ggcggctgcggaccggcctggccgggggtggg

SEQ ID NO: 1438 - DNA, 253 bp, Homo sapiens
  chr20:21376876-21377129
  hyper
cgtttcatcttgtaccggtggttctggaaccagatcttgacctgcgtgggcgtcaggtggatcatgctggccaggtgctcgcgctcgggcgccgacaggtacttctgctgcttgaagcgccgctccagctcgtagacctgcgcctgcgagaagagcacgcggcgcttccttcgcggagcggctgccgccgccgccgcgtgcagcgggcccagcgacttggcggcgtccgcgatgccggtcagcgaccccatgc

SEQ ID NO: 1439 - DNA, 168 bp, Homo sapiens
  chr20:21377473-21377641
  hyper
cgcgcccgctcggccccaggacctcctaagccgcgcgcaccccgtcccgcgcccccgcgcccctcggctgtggcgggaaacgcctgagccgcccgcagccccgcgctcctggcccctctcacttgacgagtagcgtgggtccgggttggcgccgtaccagccggtggc

SEQ ID NO: 1440 - DNA, 837 bp, Homo sapiens
  chr20:21377737-21378574
  hyper
cgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgt

SEQ ID NO: 1441 - DNA, 146 bp, Homo sapiens
  chr20:21489301-21489447
  hyper
tccgggattcactgccggcgataagcgcgctgaatggtgcggggtggggcggggggtggggggcgggccccttctccttcttcccctctctctgtccccgcgatcctttctctgtccctttttaatatgcacgcctctaacatctc

SEQ ID NO: 1442 - DNA, 80 bp, Homo sapiens
  chr20:21489621-21489701
  hyper
cgggcgccgggtccacctcccgggctcccggccggccacaggagcgcacacccagattgcaggcccgcggtcctggccac

SEQ ID NO: 1443 - DNA, 523 bp, Homo sapiens
  chr20:21490175-21490698
  hyper
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgccc

SEQ ID NO: 1444 - DNA, 88 bp, Homo sapiens
  chr20:21491258-21491346
  hyper
atagatttgggccagcgaggggggtttgctctcctcgcctttgcggctcccgaagtcacttttcctcccgtagccggacgctgccgcc

SEQ ID NO: 1445 - DNA, 319 bp, Homo sapiens
  chr20:21492507-21492826
  hyper
cgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccggg

SEQ ID NO: 1446 - DNA, 764 bp, Homo sapiens
  chr20:21493230-21493994
  hyper
ctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctg

SEQ ID NO: 1447 - DNA, 303 bp, Homo sapiens
  chr20:21501450-21501753
  hyper
tgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacaggga

SEQ ID NO: 1448 - DNA, 58 bp, Homo sapiens
  chr20:21502087-21502145
  hyper
actccagtcttcagtcgcctctccagagacctcagtccactgcgcgggccctcagccc

SEQ ID NO: 1449 - DNA, 257 bp, Homo sapiens
  chr20:21502443-21502700
  hyper
cgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgcaggcggggaccgccgcgggtgccgcgcccctccctcctcctccgcctcccagccccgcaccttcccagcccctgggacagtcccgctttccctgaccgcaccggaaagtg

SEQ ID NO: 1450 - DNA, 57 bp, Homo sapiens
  chr20:21682399-21682456
  hyper
ggtttgttagttgttcgcattcccccagggtttgcagctccccgatctggctcagct

SEQ ID NO: 1451 - DNA, 43 bp, Homo sapiens
  chr20:25061746-25061789
  hyper
aggggactgggaggacgctgcgccggcagaggagcgcggtacc

SEQ ID NO: 1452 - DNA, 334 bp, Homo sapiens
  chr20:25061978-25062312
  hyper
cgcctggcgctggggggaaaaatggccctctggagatggttgttgaagaccccagggtctcatcaaaaggttccacccggaaccaggtggtggcggtctcacatcgctgagggaacaggaccccggatgagaggcagggatttaggatgcagcaaggggcaggcggcgcagctccgcgaatgcccctcccgcgacggggcctcgctctgggctccccgcctagatctgggccgctggggccaggggtgcggtggggcgatggtctgtgacccctgcgcggctcagagcctaggggacaggggcaggagcggaaagcgcgggcctgattaccgga

SEQ ID NO: 1453 - DNA, 136 bp, Homo sapiens
  chr20:25062510-25062646
  hyper
cgccaggctggagccgtcaagccccgggcccgggcacggcgcgactgccggaccctcgcagccagatccctgtcctgggccagcgggcgccggcagctcggcctccaagcccagcaggtccgtgatggcgaagccc

SEQ ID NO: 1454 - DNA, 111 bp, Homo sapiens
  chr20:25062707-25062818
  hyper
cggaaagcgagtcccggccggtcatggttccttagcaagcaaggcgcgagcctctctggatcccgtttgcggagggcccagcttagaggaagctttataggattgggctgc

SEQ ID NO: 1455 - DNA, 71 bp, Homo sapiens
  chr20:25062870-25062941
  hyper
cgccgttccggaccccgcgagatggggacgccaccagttcccctcccctcggttaccgcccacccagctgc

SEQ ID NO: 1456 - DNA, 180 bp, Homo sapiens
  chr20:25063727-25063907
  hyper
tattgtccaatttcacgattattcaaagaaagcctgattctttgaataatcagtgaaactctgatattcgctaaagttggccccaagcacgtgggtaagtaactactggttcgcgctttgaacccaaccagccctcatcgctcggagccctgcgtcccccgcttcccaatcccagaaccc

SEQ ID NO: 1457 - DNA, 518 bp, Homo sapiens
  chr20:25063993-25064511
  hyper
cgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaa

SEQ ID NO: 1458 - DNA, 28 bp, Homo sapiens
  chr20:25065179-25065207
  hyper
ccacccagagcccagcgtcaagttatac

SEQ ID NO: 1459 - DNA, 187 bp, Homo sapiens
  chr20:25065208-25065395
  hyper
ggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgg

SEQ ID NO: 1460 - DNA, 24 bp, Homo sapiens
  chr20:34188608-34188632
  hyper
ttctttttcttctttcgggtgagc

SEQ ID NO: 1461 - DNA, 342 bp, Homo sapiens
  chr20:34188747-34189089
  hyper
cgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcct

SEQ ID NO: 1462 - DNA, 326 bp, Homo sapiens
  chr20:34189166-34189492
  hyper
cggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggca

SEQ ID NO: 1463 - DNA, 375 bp, Homo sapiens
  chr20:34189679-34190054
  hyper
cggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctgg

SEQ ID NO: 1464 - DNA, 796 bp, Homo sapiens
  chr20:37302580-37303376
  hyper
tggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaa

SEQ ID NO: 1465 - DNA, 401 bp, Homo sapiens
  chr20:37352115-37352516
  hyper
ttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggc

SEQ ID NO: 1466 - DNA, 20 bp, Homo sapiens
  chr20:37352606-37352626
  hyper
cggggcgcccagaccagtcc

SEQ ID NO: 1467 - DNA, 284 bp, Homo sapiens
  chr20:37353435-37353719
  hyper
gatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacgg

SEQ ID NO: 1468 - DNA, 1026 bp, Homo sapiens
  chr20:37353806-37354832
  hyper
cgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccc

SEQ ID NO: 1469 - DNA, 239 bp, Homo sapiens
  chr20:37354993-37355232
  hyper
cgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaag

SEQ ID NO: 1470 - DNA, 541 bp, Homo sapiens
  chr20:37355502-37356043
  hyper
accctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatc

SEQ ID NO: 1471 - DNA, 297 bp, Homo sapiens
  chr20:37356168-37356465
  hyper
cgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttg

SEQ ID NO: 1472 - DNA, 365 bp, Homo sapiens
  chr20:37357825-37358190
  hyper
ggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctca

SEQ ID NO: 1473 - DNA, 224 bp, Homo sapiens
  chr20:37434129-37434353
  hyper
ttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgt

SEQ ID NO: 1474 - DNA, 234 bp, Homo sapiens
  chr20:37434488-37434722
  hyper
cgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctg

SEQ ID NO: 1475 - DNA, 158 bp, Homo sapiens
  chr20:37434736-37434894
  hyper
cgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcg

SEQ ID NO: 1476 - DNA, 440 bp, Homo sapiens
  chr20:37434930-37435370
  hyper
cgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcc

SEQ ID NO: 1477 - DNA, 229 bp, Homo sapiens
  chr20:37435487-37435716
  hyper
cgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggccc

SEQ ID NO: 1478 - DNA, 132 bp, Homo sapiens
  chr20:37435717-37435849
  hyper
gaggtacaggcgccctttcccgcagggctctccctggaaagggcctgccgatggcggcctcagtccgcaggggtacttccctgtgtaccctgccatttcctgcggctggtgaagcaccggagaaaaaccgtc

SEQ ID NO: 1479 - DNA, 236 bp, Homo sapiens
  chr20:41818513-41818749
  hyper
tcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctc

SEQ ID NO: 1480 - DNA, 211 bp, Homo sapiens
  chr20:41818804-41819015
  hyper
cgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataa

SEQ ID NO: 1481 - DNA, 836 bp, Homo sapiens
  chr20:42543698-42544534
  hyper
gctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgc

SEQ ID NO: 1482 - DNA, 257 bp, Homo sapiens
  chr20:42544727-42544984
  hyper
cgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggc

SEQ ID NO: 1483 - DNA, 128 bp, Homo sapiens
  chr20:45279854-45279982
  hyper
acactgggacctcagcggtctcccaacttggaggcttgggagaagaggatcccgcctgtggttgaccgggggcgcacaggcggaggaggcgttaccttgggcgggagggcgaagaccaccggcagcag

SEQ ID NO: 1484 - DNA, 218 bp, Homo sapiens
  chr20:45280039-45280257
  hyper
cgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagtta

SEQ ID NO: 1485 - DNA, 809 bp, Homo sapiens
  chr20:50720392-50721201
  hyper
aacatataagctattcgtttagtggaggcttcattaaactactcccctccaccaccacctcgggaagttgtggtcaaaacccaccagaccgactgtggtggaagttgatgcggaagctggagagcccgcggctctggaggggtgagccgccccggagaggggacccatcctcctttccgcgcccggaaagagcgggggagaagaggaagtccagttacaactcctttcctcagccccttaaaggaaaggtatcagctaaccacggggagctggcagcctaagagaaagtaggaacctacaatctcttaatctaagcacaagataagcaaaaagggaagcgccttagaaatgcagattccccaaccccacccctgagattccagtggaggcgggggatggggggatccctaacttgcaggaagaatttggcgagcgagaaaaggtcccctcccgcaggctcttctgaagcggaggatcccgggacgagaaatgctgcccggggggcttaaggtagccgacgatctccttgctacatcctgtgtccacgtggcagccgaggagggggtgtgggggccgcctgttaagtgcgacagcatcactgctctatccccaccacggctcccacttcgctcagataaaatgcagagctcttaccaaggctcacggccgtcccccgccccccaccgtctgcccccatcacctctcgggcctccggtgacctctcgggctacagcagcgctgacgccctgggtccctgcgcttctgttccctcggcctggaatgctcttcccccgggtacctgcacagct

SEQ ID NO: 1486 - DNA, 437 bp, Homo sapiens
  chr20:50721234-50721671
  hyper
cgtccgctcctcggtgaggccttccctggacaacgcatttgaaacgtaaccccaaggcaagaagccaccttccaggcgcgcagccgaagcccagtgccaaggaggccggagactcgggtgcccgcgcatcccgaaaacagcctctgaggggtcctctgagcatccttccagcgtgtttgggaggcaaactcgttgactagctcttgagaggagtggctagaggaatccaggcggggaaggggacggtggactccaggagagtgtaatttacaaaggcggggggcggggacgcccaggtccgagtcccaggactctgcgccggacgcttcgcccgccctttcaggtcccctgcccggtcctcgtacccgcgcgggtccggagaacctctgagcaccggcccccagcccccgggcggggctccagcggcgctactcacc

SEQ ID NO: 1487 - DNA, 413 bp, Homo sapiens
  chr20:55199898-55200311
  hyper
actgaagaagtcctacgtaccgcttgtcatatacatatgtaaagataatttaaaaccctagggtatacccttttcaaatgcagagtttatagtttccaaggggaggagggcaggggaggagtaaccaggacctttcctgccagtcttccaatcgcgatagctcgttttggctgtgaatttccccccttcccctccccctcccgttaattaaataaacgctggaagcgtgtgtttaccgcacacgactcggccctcggggaactctttttctacgtctctcctactcttaaactcctcaactcacagagggttggagagctggcaccatgagcttccagttcctacgggtgagaaaagaggtgtctgtgtggagggcaggtgcgaccccgggggctagcagagaggagaggctg

SEQ ID NO: 1488 - DNA, 98 bp, Homo sapiens
  chr20:55200615-55200713
  hyper
cgtacggatgggctccgggatgttagtggagaggtgacaggagtctaccatcccacggccaagcgtgtgaggcctccggcgggcgggggtcccccccg

SEQ ID NO: 1489 - DNA, 264 bp, Homo sapiens
  chr20:57224816-57225080
  hyper
gcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccggg

SEQ ID NO: 1490 - DNA, 177 bp, Homo sapiens
  chr20:57225218-57225395
  hyper
cgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcg

SEQ ID NO: 1491 - DNA, 29 bp, Homo sapiens
  chr20:61637928-61637957
  hyper
ggggaggtcgccgcccgggcccggagtgc

SEQ ID NO: 1492 - DNA, 250 bp, Homo sapiens
  chr20:61638220-61638470
  hyper
cgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggac

SEQ ID NO: 1493 - DNA, 118 bp, Homo sapiens
  chr20:61638534-61638652
  hyper
cgactccccggccgccgcctccggccgccccggggattccgccaccaaacgcacgcgtcccaggtgggcacccgcctcggtccgtctttgagtctgaccctagcgcaagagtccctgg

SEQ ID NO: 1494 - DNA, 53 bp, Homo sapiens
  chr20:61703709-61703762
  hyper
cggagggaggcccggcgggaacgggcgccccctttgcacccacagccgtggaa

SEQ ID NO: 1495 - DNA, 190 bp, Homo sapiens
  chr20:61703845-61704035
  hyper
cgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctca

SEQ ID NO: 1496 - DNA, 200 bp, Homo sapiens
  chr20:61808181-61808381
  hyper
ccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccgg

SEQ ID NO: 1497 - DNA, 222 bp, Homo sapiens
  chr20:61808666-61808888
  hyper
cgtttccttgggtctccgtgtggccgccgggcgcagggcacggtcgagggcgctcgatggctgagtccgcgtgagccgaggagcgcgcggggcgggacgcggtgcgaatgcgcgggaggcacgaggcgcgcagtgcgtgtgtgcgcgtgtgcgcggcgcgcgtgccccgcagttctcaaggacacctcggggaggcagcggcggggccggtgtccgggtgac

SEQ ID NO: 1498 - DNA, 117 bp, Homo sapiens
  chr20:61808889-61809006
  hyper
tcaccgcgcgccccagtgataatcggccggtgccggagcggagcgcggatacgcgcggaggcaacggcgacggcggcggcggcggcgggcgcggggacagttgcatcggggccgggc

SEQ ID NO: 1499 - DNA, 339 bp, Homo sapiens
  chr20:61809218-61809557
  hyper
cggctcccgccgggactggtaattacgctcggggccgggccggggcgagccgggcaagcggcctctctgggtctccccgtctttctctccacgaacagctcgagcgccttctcgcgggcccgctgcgcgcggagaggacgagctcgctgggttgtaaaaagagacgagttttcatctttgagcatcgagattcgttcttttaaccgcattcggtgcgcgctcctgggtcggcacgggcagggcgacggcaggggaaggcagctgcggaggagctcgcgccgcccagtcggagcggttctgcgcccctcggagccccgcgggaggcggccgggtgcgcac

SEQ ID NO: 1500 - DNA, 74 bp, Homo sapiens
  chr20:61809558-61809632
  hyper
cgctcaccacccccacccccggaatccgtcttcgcgattcccgggcgccccagctccaggaacgcccggaggga

SEQ ID NO: 1501 - DNA, 295 bp, Homo sapiens
  chr20:61809840-61810135
  hyper
cgccccagccctgagggcccctctgcgtgttcacagcggaccttgatttaatgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctgg

SEQ ID NO: 1502 - DNA, 638 bp, Homo sapiens
  chr21:34392436-34393074
  hyper
cgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctg

SEQ ID NO: 1503 - DNA, 696 bp, Homo sapiens
  chr21:34396045-34396741
  hyper
aaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaa

SEQ ID NO: 1504 - DNA, 93 bp, Homo sapiens
  chr21:34399166-34399259
  hyper
ggccatggactcggacgccagcctggtgtccagccgcccgtcgtcgccagagcccgatgacctttttctgccggcccggagtaagggcagcag

SEQ ID NO: 1505 - DNA, 664 bp, Homo sapiens
  chr21:34399441-34400105
  hyper
cgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgc

SEQ ID NO: 1506 - DNA, 27 bp, Homo sapiens
  chr21:34400231-34400258
  hyper
cgcgaggaggggcgcaggaccatggac

SEQ ID NO: 1507 - DNA, 382 bp, Homo sapiens
  chr21:34443981-34444363
  hyper
cggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtac

SEQ ID NO: 1508 - DNA, 154 bp, Homo sapiens
  chr21:34444444-34444598
  hyper
cgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttga

SEQ ID NO: 1509 - DNA, 96 bp, Homo sapiens
  chr21:36041933-36042029
  hyper
actgaggccgaggagggagccccggagggtgccgaggtgccccaaggaggggaggagacaagcggcgcgcagcaggtggagggggcgagcccggga

SEQ ID NO: 1510 - DNA, 79 bp, Homo sapiens
  chr21:36042091-36042170
  hyper
cgagaggcaggaggaggcggagcagaggcctgaggtcccggaaggtagcgcgtccggggaggcgggggacagcgtagac

SEQ ID NO: 1511 - DNA, 144 bp, Homo sapiens
  chr21:36042171-36042315
  hyper
cggagggcccgctgggggacaacatagaagcggagggcccggcgggcgacagcgtagaggcggagggccgggtgggggacagcgtagacgcggaaggtccggcgggggacagcgtagacgcggagggcccgctgggggacaaca

SEQ ID NO: 1512 - DNA, 38 bp, Homo sapiens
  chr21:44494740-44494778
  hyper
aatcttccagaaagccgtggacccgaggccccggcaga

SEQ ID NO: 1513 - DNA, 57 bp, Homo sapiens
  chr21:44494940-44494997
  hyper
cgggctccccaagacaacagcgccgggcggccggatgcacgtgcgtcccgggaaggc

SEQ ID NO: 1514 - DNA, 122 bp, Homo sapiens
  chr21:44494998-44495120
  hyper
ggttcagctggcatcgcctggccggttccgttcgctccttaaaccacaagacccccttggggtcacgacgttcccggggcacccctgcactcgcgcgccagcactcccggaggggcctgggg

SEQ ID NO: 1515 - DNA, 73 bp, Homo sapiens
  chr21:47010408-47010481
  hyper
gccccgggagttcgaagggtgctggggccgaggggaaggctctggtcggcggcgtcagcggcagctcccagac

SEQ ID NO: 1516 - DNA, 15 bp, Homo sapiens
  chr22:19510932-19510947
  hyper
ggagaaggtcagctg

SEQ ID NO: 1517 - DNA, 315 bp, Homo sapiens
  chr22:19511141-19511456
  hyper
cgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggcca

SEQ ID NO: 1518 - DNA, 335 bp, Homo sapiens
  chr22:19511541-19511876
  hyper
cgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcc

SEQ ID NO: 1519 - DNA, 67 bp, Homo sapiens
  chr22:19512252-19512319
  hyper
cgacccccagtctgcaccacccagtccactcccacatccccgactgagccgggtggtctcttccact

SEQ ID NO: 1520 - DNA, 15 bp, Homo sapiens
  chr22:19512376-19512391
  hyper
cgtagaggccctcgt

SEQ ID NO: 1521 - DNA, 198 bp, Homo sapiens
  chr22:33453877-33454075
  hyper
gcaggtcctaggagccggcgcagagcagaggtccggccgctgcggttcctggtttcccgcaagctcttccccgggccgggcgctgggtggaggcagtcttaggatccacagtcttgcgcgcccccggctcccgggcccggcagacggcccccgcacgccgatctgtctgtcccagggaccggcccagggccccggcag

SEQ ID NO: 1522 - DNA, 66 bp, Homo sapiens
  chr22:33454193-33454259
  hyper
cgcaccagcagcccccgctcgaggtggggtctcccggctgtcagaaaccccacaaagtctactttg

SEQ ID NO: 1523 - DNA, 90 bp, Homo sapiens
  chr22:33454345-33454435
  hyper
gggtcccgggagctcagcctctgcccctcaacgcgcgcgagcgcccccgcccggcggcccggcctccccgcgccgcggcgccccattggc

SEQ ID NO: 1524 - DNA, 148 bp, Homo sapiens
  chr22:48971532-48971680
  hyper
ggcaccgtccggtggggaccggcccgccagccccgggccgcgcaagttcgatcgccgcgggctcggccgggccgcgcggaccccggcggcggcgatggtgcggcagccccgcgcccggcgcgcagccccggccccgagcctggcccgc

SEQ ID NO: 1525 - DNA, 201 bp, Homo sapiens
  chr22:48971758-48971959
  hyper
cggcggcggaggaagaggaggaggaggaaggcgacgccgagcagcgggcggtgggggccgacaggcggaggagggggccggggccgcgccggaccccccccccccccgcgccgcccggccgttgcgcaatccgcggcccgccgtccgggccctgctggcggtgcggctccgggggcggcggcggggctgattcatggggcc

SEQ ID NO: 1526 - DNA, 176 bp, Homo sapiens
  chr22:48971960-48972136
  hyper
cggcggccgccccccggcgccccgcagccagcgatggtggccgagtggtcggagcggcggccgccgcggcccgagactttctgctaacctccccgcccccgcccgccccctccgcggcgcccccctccccccgcccgctcccctcccccctgcccagaaagacacaaatcgcctcc

SEQ ID NO: 1527 - DNA, 88 bp, Homo sapiens
  chr22:51042317-51042405
  hyper
agtcgccagtgcgcccgggttgcgactgcgaagggaaccggcctgcggaaccccctgcgccaggggggacttcgccctcctcagatcc

SEQ ID NO: 1528 - DNA, 109 bp, Homo sapiens
  chr22:51042457-51042566
  hyper
cgcagcagccaggagctgtcctcgcccggctccgactcggaggacgcgggcggcgccgcctggggcgcatgatctcgtccatctcggagacggagctggagctgagcag

SEQ ID NO: 1529 - DNA, 420 bp, Homo sapiens
  AC241851.2_88-34049:15130-15550
  hyper
cttgcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcc

SEQ ID NO: 1530 - DNA, 146 bp, Homo sapiens
  chr1:1235932-1236078
  hypo
tgagggtgagggccccggtggcttcctccacctcgtggggccggtgcctcggggcctgggcgttcctcaccagggacagctccaggtcctcccgcaccttgtcaaactgcttctttgtctccttgaacttccgcacatccctggag

SEQ ID NO: 1531 - DNA, 692 bp, Homo sapiens
  chr1:1267466-1268158
  hypo
accgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccc

SEQ ID NO: 1532 - DNA, 128 bp, Homo sapiens
  chr1:6166321-6166449
  hypo
gggaagtctcgaggacggctagatatctgtcaaaaaaagaggagagccgggcttgcctgacgttggcagcagcaggcaggccgggcccggcgggcacccgtgtgcatgctgcccggagcggacgggca

SEQ ID NO: 1533 - DNA, 156 bp, Homo sapiens
  chr1:39416821-39416977
  hypo
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttttcttttcttttttt

SEQ ID NO: 1534 - DNA, 37 bp, Homo sapiens
  chr1:45645619-45645656
  hypo
aggagccaagatggccgaataggaacagctctggtct

SEQ ID NO: 1535 - DNA, 98 bp, Homo sapiens
  chr1:86860851-86860949
  hypo
gttgcacttaaaactccaagaacctcattcattcaaaaacacttgaaaccgtactatgcgttgcgtgatgaggaaactgtcttcgaaatagattttat

SEQ ID NO: 1536 - DNA, 28 bp, Homo sapiens
  chr1:94343568-94343596
  hypo
aaatcaaaatttggccgggcgcggtggc

SEQ ID NO: 1537 - DNA, 79 bp, Homo sapiens
  chr1:151170062-151170141
  hypo
tgttttaatggagttatttcatgggccatgagtttgagaggatctatctgaccgactcttaccccgaatgttttaccat

SEQ ID NO: 1538 - DNA, 102 bp, Homo sapiens
  chr1:151252684-151252786
  hypo
gaaactctccgggtgcgccggggagtcctggttccggtgtcctgggactcctgggcagggtaacgaaaccacttttaaaaactttgccgggcccggtgggtc

SEQ ID NO: 1539 - DNA, 45 bp, Homo sapiens
  chr1:153937124-153937169
  hypo
gacttcttaaggggccgggcgcggtggttcacgcctgtaatccaa

SEQ ID NO: 1540 - DNA, 40 bp, Homo sapiens
  chr1:156030121-156030161
  hypo
ccttcaggatggtctcgatctcctgaccttgtgatccgcc

SEQ ID NO: 1541 - DNA, 16 bp, Homo sapiens
  chr1:158591676-158591692
  hypo
ggagtcttgctctgtc

SEQ ID NO: 1542 - DNA, 15 bp, Homo sapiens
  chr1:158591932-158591947
  hypo
cgtgagccactgcac

SEQ ID NO: 1543 - DNA, 199 bp, Homo sapiens
  chr1:195732322-195732521
  hypo
tgagattttggtggccgcggaaagtaggaacgagagagctggagcacgccccctacctctttggcctctgtggttgctggcgtctcactcaggtttttgggtgccactgtgttcccctcatccagaccctggtacttgcagcggaagccgcctgtggtacacctggtccagctgcagcctcgcaaggagctggtgccgg

SEQ ID NO: 1544 - DNA, 80 bp, Homo sapiens
  chr2:10156306-10156386
  hypo
ggtggacaggcgtgtgtatgggtgagtcaggtggaccactgtgtgtacgggcgagtcaggtggaccggcgtgcatatggg

SEQ ID NO: 1545 - DNA, 39 bp, Homo sapiens
  chr2:20642609-20642648
  hypo
acaggcgtgagccaccgcgcccggcggaaatatttttaa

SEQ ID NO: 1546 - DNA, 240 bp, Homo sapiens
  chr2:47598278-47598518
  hypo
cggccttaaaaacaagatttaaaatggtgactggtatgttgcaccgttattcaaatgttagacatgtagtttgatttcagtttctcttaactgtggaataaacaacttggctgccgtctctctctctctcttttttttggaaacagtgtctccgtctgtcgttcagcctggagtgcagtggcacatttacatgtcactgcgtcctccatttcccaggctcaagcgatgctcttacttgga

SEQ ID NO: 1547 - DNA, 42 bp, Homo sapiens
  chr2:47598578-47598620
  hypo
gtaagatggtgcctagaagtggagtggcgtttgccaaaggtc

SEQ ID NO: 1548 - DNA, 24 bp, Homo sapiens
  chr2:67625740-67625764
  hypo
tacagccaccgcgcccggccacct

SEQ ID NO: 1549 - DNA, 160 bp, Homo sapiens
  chr2:74454159-74454319
  hypo
gtgaagaggtggatccggcgcagcggcacgtgccgcaggaaggcatggtccggctggtgcttggctggcatcaggaagagcttgcagcgttcccagaactagggggacagcgggggctcagccaggcagccagaccccgagggcccgctgggtcctggga

SEQ ID NO: 1550 - DNA, 92 bp, Homo sapiens
  chr2:97427763-97427855
  hypo
agatgttgaaggtgacggagccctataatgacctcgtgaaagaggagctcaatatgatccagggtgccctggaactacggaccaaaactgta

SEQ ID NO: 1551 - DNA, 100 bp, Homo sapiens
  chr2:99798646-99798746
  hypo
ttttacagaagacagcgtaattgtttcagggtccaggagttacgtgcctaattattaacagtaacttttactttattaaaacgtattccttgccgggcgt

SEQ ID NO: 1552 - DNA, 21 bp, Homo sapiens
  chr2:128616617-128616638
  hypo
aaaaatgaattgtgccgggca

SEQ ID NO: 1553 - DNA, 39 bp, Homo sapiens
  chr2:128847684-128847723
  hypo
atcctcagcgtgagccaccgcgcccggcctccatcagtg

SEQ ID NO: 1554 - DNA, 27 bp, Homo sapiens
  chr2:170681885-170681912
  hypo
agaggcagggcgcggcggctcacgcct

SEQ ID NO: 1555 - DNA, 27 bp, Homo sapiens
  chr2:170682152-170682179
  hypo
agagcgagactccgtctcaaaaaaaaa

SEQ ID NO: 1556 - DNA, 143 bp, Homo sapiens
  chr3:101230961-101231104
  hypo
ccaataaatctgtaattgttaactgtctctgcagaaaccaacggtaccatcagaaacagaaaaatgaaatgaaataattgattcattgggcgttcgtttgtgtactggactgtaagcatatgagtcctcgtcctctcctccta

SEQ ID NO: 1557 - DNA, 235 bp, Homo sapiens
  chr3:169540374-169540609
  hypo
ccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcagg

SEQ ID NO: 1558 - DNA, 90 bp, Homo sapiens
  chr3:185271296-185271386
  hypo
taattccctttctggcgagagtgcttgcaacactaactcaggcttctagtggtctgatgagcttaaaaatcaattaataagccgggcgcg

SEQ ID NO: 1559 - DNA, 86 bp, Homo sapiens
  chr4:95127609-95127695
  hypo
tgagaaacggtagaacgatggctaccagaggctgggaagggtagtgtggggcgggggaggaccccggtggtcggtgagcatggtta

SEQ ID NO: 1560 - DNA, 836 bp, Homo sapiens; identical to SEQ ID NO: 409
  chr5:1294607-1295443
  hypo

SEQ ID NO: 1561 - DNA, 33 bp, Homo sapiens
  chr5:43402630-43402663
  hypo
aaaattggtgtgtgccggttccaagatggccga

SEQ ID NO: 1562 - DNA, 30 bp, Homo sapiens
  chr5:154209957-154209987
  hypo
gttatccattgttttcgcagctgtctccct

SEQ ID NO: 1563 - DNA, 19 bp, Homo sapiens
  chr5:154318148-154318167
  hypo
atatgcacaagaggccggg

SEQ ID NO: 1564 - DNA, 30 bp, Homo sapiens
  chr6:4951289-4951319
  hypo
gtgctctccaagctgcgggtttcacatgca

SEQ ID NO: 1565 - DNA, 186 bp, Homo sapiens
  chr6:12288517-12288703
  hypo
aggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgtcctccgggagctgtggcct

SEQ ID NO: 1566 - DNA, 97 bp, Homo sapiens
  chr6:86302345-86302442
  hypo
tcaattttaacctttcggaatatttcaggtttttttggggagggtggcatcaagtcctcttaagaatattatagggatgtggccgggtgcggtggct

SEQ ID NO: 1567 - DNA, 24 bp, Homo sapiens
  chr6:134067447-134067471
  hypo
gagccaccgcgcccagcctgcctg

SEQ ID NO: 1568 - DNA, 104 bp, Homo sapiens
  chr6:134589500-134589604
  hypo
caactgtttgtgaagcgcattgtaaacaaacatagacggggtgagacatcctctttatcctgaataaatcaagaattcccaggccgggcgctgtggctcatgcc

SEQ ID NO: 1569 - DNA, 89 bp, Homo sapiens
  chr7:1641847-1641936
  hypo
ttgtctgtgccatttcggtgccttttgtccttgcttcccgccgctccttgaggatgtttaccggctgctggggccgtgccttccaggtg

SEQ ID NO: 1570 - DNA, 164 bp, Homo sapiens
  chr7:1733214-1733378
  hypo
catctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaac

SEQ ID NO: 1571 - DNA, 85 bp, Homo sapiens
  chr7:6124629-6124714
  hypo
gcgagccaccgcacccagccaaggactcttaagtgtaactgatccaccctacttttctccctggcatgaacgactgtgcccagcc

SEQ ID NO: 1572 - DNA, 273 bp, Homo sapiens
  chr7:7605157-7605430
  hypo
cctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtggctcatg

SEQ ID NO: 1573 - DNA, 152 bp, Homo sapiens
  chr7:7605670-7605822
  hypo
atagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcac

SEQ ID NO: 1574 - DNA, 264 bp, Homo sapiens
  chr7:44835120-44835384
  hypo
ctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtg

SEQ ID NO: 1575 - DNA, 30 bp, Homo sapiens
  chr7:128097589-128097619
  hypo
agacaagctgagcaccgttgtaaccagaga

SEQ ID NO: 1576 - DNA, 223 bp, Homo sapiens
  chr7:155581330-155581553
  hypo
ggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtc

SEQ ID NO: 1577 - DNA, 22 bp, Homo sapiens
  chr8:66560523-66560545
  hypo
ttacaggcgtgagtcaccatgc

SEQ ID NO: 1578 - DNA, 137 bp, Homo sapiens
  chr8:90913516-90913653
  hypo
gtccgcctcggccttccaaaaggaatttaggtactttaaaatgctgttatgtatgttaacggaaaagtaactacatgcttcattttcagaaccaacattcaaatgaaatgaacgtgtcaaatcgacaaaagctcaaa

SEQ ID NO: 1579 - DNA, 16 bp, Homo sapiens
  chr8:103629866-103629882
  hypo
acgtagacctaacaaa

SEQ ID NO: 1580 - DNA, 91 bp, Homo sapiens
  chr8:133686745-133686836
  hypo
tggggagctcaaaaacgttgtcgatatcaaaatggttcatacaatataaataacttacccgcatcaccttgcagtttgttagtatattctt

SEQ ID NO: 1581 - DNA, 105 bp, Homo sapiens
  chr9:6756353-6756458
  hypo
tggttgggatcctgacgttacatgcacacatttggaaaattcccagttgagtatacgttagccaagttcagaattgtgtgtggccgggtgaagtggctcacgcct

SEQ ID NO: 1582 - DNA, 22 bp, Homo sapiens
  chr9:131580093-131580115
  hypo
tttgccaatctgggccgggcgc

SEQ ID NO: 1583 - DNA, 121 bp, Homo sapiens
  chr9:139012272-139012393
  hypo
ccctcccatgtggctcgtgctgggacgccggcaccgtgagatggcgcccgtggccagatagagggtggcgtgtaaagcaggtggtcacccgtcactcgacttttcgcgtgctggtgagggt

SEQ ID NO: 1584 - DNA, 17 bp, Homo sapiens
  chr9:139703929-139703946
  hypo
atgaaagttggtgtccg

SEQ ID NO: 1585 - DNA, 136 bp, Homo sapiens
  chr9:139704066-139704202
  hypo
aaatacgaaaaaaaaatttaaaagaaagttgatgtccgaaccaagggccgtattggcttttcttatactctagaacatacgacgacaaagaagattttgatgaagttcaaattagagtcagcgtgctcatcagaaa

SEQ ID NO: 1586 - DNA, 37 bp, Homo sapiens
  chr10:5875322-5875359
  hypo
aaagagaaaaggggccgggcgcagtggctcacgcctg

SEQ ID NO: 1587 - DNA, 226 bp, Homo sapiens
  chr10:98129781-98130007
  hypo
catcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtc

SEQ ID NO: 1588 - DNA, 22 bp, Homo sapiens
  chr10:98528164-98528186
  hypo
cagaccacggactgatacaggt

SEQ ID NO: 1589 - DNA, 421 bp, Homo sapiens
  chr10:133951502-133951923
  hypo
agccagcccagacaccgtcttccctgtcatccaaatgatggcacacgggcagtaaaccgtggactgaaaccggtggagctgctctaccacttacacaacctcttcaactggcttccgcaggagcgggacaagctgttaagattccggaagcaaagaaagaaaatggcaaaacttcccaaggtaaggaacagcacaccggcacgtgcggagagtacgccgggtgtgtgcggagaggaccacgcccgcgtgtgtggagagcgctggtgtgtgcggagaggggtgcgccggtgtacgtggagggcgctgggtgtgtgtgccgaggaccgcgcccacgtgtgtggagagtatgccgggtgcgtgtggagaggaccgcgcccgcgtgtgtggagagtacgccgggtgtgtgcggagaggggtgcgc

SEQ ID NO: 1590 - DNA, 212 bp, Homo sapiens
  chr10:134095580-134095792
  hypo
ctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgc

SEQ ID NO: 1591 - DNA, 163 bp, Homo sapiens
  chr11:9405392-9405555
  hypo
tggtaattactaatacgtaatgtgataaaaacctttcacacataaagttcatttaatcttccgtgttattgccttaggataaagtctcataagtggaattactgggtcagagtttaaacatttcgtttcgttttgtttttttgagacggagtttcgctcttgt

SEQ ID NO: 1592 - DNA, 82 bp, Homo sapiens
  chr11:66513182-66513264
  hypo
ggctagaacccagggcgctgactcataggccagtgttcttttcccaactgcgctgtcataccgacatgagaatatctttagg

SEQ ID NO: 1593 - DNA, 82 bp, Homo sapiens
  chr11:66513564-66513646
  hypo
caccgtgcccggcccgatatgggaatatcgtaacagaggacgtgtgaaggaatagttagactctacacgtacctggaaacca

SEQ ID NO: 1594 - DNA, 157 bp, Homo sapiens
  chr11:67072239-67072396
  hypo
ccaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatccca

SEQ ID NO: 1595 - DNA, 72 bp, Homo sapiens
  chr11:69280561-69280633
  hypo
gagaacactgactcccggggaggtggattacctgtcctcccggcaaagcgcaggactcgcagtttggcaagc

SEQ ID NO: 1596 - DNA, 45 bp, Homo sapiens
  chr11:102961347-102961392
  hypo
aaagcatttctcagtcgggcgaggtggctcactcctgtaatccca

SEQ ID NO: 1597 - DNA, 89 bp, Homo sapiens
  chr12:12848467-12848556
  hypo
attggtcagatccctcgagacagttcccaaattcctgacttctgttaccgcgactgttcttcgcaattccacctcggcctgtgttcagg

SEQ ID NO: 1598 - DNA, 147 bp, Homo sapiens
  chr12:49657607-49657754
  hypo
aagggtttaattcctcggagctctactttcctcatctgtaaactagggataataattcatagagtttgtcatatggatgaaatgtgatcatgtgatatgaaaagccaactactcggccaggcgcggtggctcacgcctgtattccca

SEQ ID NO: 1599 - DNA, 97 bp, Homo sapiens
  chr12:54720206-54720303
  hypo
agccactgcgccgggccaggaattcttattgtatgatctaggatgctaatttctccctctctggttacatgagaattgtggtcgctaaagggctgta

SEQ ID NO: 1600 - DNA, 23 bp, Homo sapiens
  chr12:96881015-96881038
  hypo
gtgagccacgacacccagccaat

SEQ ID NO: 1601 - DNA, 101 bp, Homo sapiens
  chr12:122278479-122278580
  hypo
acaggcgtgagccaccatgacctgctgcgggatcttttaaaagtcggatcatgtcattcccctgtttaaaatcctccagtggaaatcggaaccctcatgta

SEQ ID NO: 1602 - DNA, 522 bp, Homo sapiens
  chr12:132221602-132222124
  hypo
agcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccg

SEQ ID NO: 1603 - DNA, 528 bp, Homo sapiens
  chr13:114780555-114781083
  hypo
cggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgt

SEQ ID NO: 1604 - DNA, 85 bp, Homo sapiens
  chr15:78596048-78596133
  hypo
caggcgtgagccaccgcgcccggccactgtttacactattgttgcagtagctgctgccatcaccgggctgcggcagggaggcaca

SEQ ID NO: 1605 - DNA, 283 bp, Homo sapiens
  chr16:726729-727012
  hypo
tgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgg

SEQ ID NO: 1606 - DNA, 205 bp, Homo sapiens
  chr16:845955-846160
  hypo
cagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccagga

SEQ ID NO: 1607 - DNA, 28 bp, Homo sapiens
  chr16:1407453-1407481
  hypo
agtcacccagcacctcgtgtgtatttcg

SEQ ID NO: 1608 - DNA, 336 bp, Homo sapiens
  chr16:2234684-2235020
  hypo
ccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaa

SEQ ID NO: 1609 - DNA, 197 bp, Homo sapiens
  chr16:31446899-31447096
  hypo
cgcccgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattc

SEQ ID NO: 1610 - DNA, 18 bp, Homo sapiens
  chr16:68876852-68876870
  hypo
tttgagatggagtctcgc

SEQ ID NO: 1611 - DNA, 465 bp, Homo sapiens
  chr16:87723648-87724113
  hypo
gggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatgggga

SEQ ID NO: 1612 - DNA, 312 bp, Homo sapiens
  chr16:88943712-88944024
  hypo
ctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggc

SEQ ID NO: 1613 - DNA, 71 bp, Homo sapiens
  chr16:89220327-89220398
  hypo
gggcagagacagctgcggtggcccggtgcacctgcctggcctcaggatggccgaggcgcctggcaaggctg

SEQ ID NO: 1614 - DNA, 120 bp, Homo sapiens
  chr17:2207818-2207938
  hypo
gagccaccgcgcccggccgccccctgacttttaaaaactagatacgatatagttggaatcgtgtggaaggaagtacatcaggaggcatataagtccatttgggacctgtaatcccggcga

SEQ ID NO: 1615 - DNA, 30 bp, Homo sapiens
  chr17:3658849-3658879
  hypo
gcacacagaaaaaagcgacctcctgtcatc

SEQ ID NO: 1616 - DNA, 142 bp, Homo sapiens
  chr17:25620573-25620715
  hypo
agtccagagaggccccgcggcgcggtgcggcgcgatcacgcccgagtctccttctcgttcccctcggcccttcctaaaacctgctggctcaggtctgaacaatcgcagctggacaggtggtgcacaacgatgttaattttca

SEQ ID NO: 1617 - DNA, 33 bp, Homo sapiens
  chr17:26927180-26927213
  hypo
aaatatcgccaggtgcggtggctcatgcctgta

SEQ ID NO: 1618 - DNA, 146 bp, Homo sapiens
  chr17:39682499-39682645
  hypo
acaggcatgagccaccgcgcccggccgattgtgtagttttttaatgcaacagaataggctacaaaatatcagaggggatttctcttagtatggtgagaattgtgtcacccatttgtgtgtgtgcatgtgcacgcacacacacacac

SEQ ID NO: 1619 - DNA, 102 bp, Homo sapiens
  chr17:42331669-42331771
  hypo
ctccaaattatacaacttctggtcccacaaaacctggaactgcccctggcttttcactattcctgctagtcgggagggccacacacccgcagggactagctt

SEQ ID NO: 1620 - DNA, 120 bp, Homo sapiens
  chr17:49229470-49229590
  hypo
gtcacgagaatcgcttgaacccggatggcggagtttgcaatgaaccgacatcgtgcaactgcgctccggcctgggcgccaaagcgatactcggtctcaaaaagaaaaaaaagaaaacagg

SEQ ID NO: 1621 - DNA, 37 bp, Homo sapiens
  chr17:57297023-57297060
  hypo
ggattacaggcgtgggccaccgcgcccggctgaatca

SEQ ID NO: 1622 - DNA, 19 bp, Homo sapiens
  chr17:73031621-73031640
  hypo
actccagtctctggccggg

SEQ ID NO: 1623 - DNA, 31 bp, Homo sapiens
  chr17:76211256-76211287
  hypo
ggaggctgaggcgggcggatcacctgaggtc

SEQ ID NO: 1624 - DNA, 91 bp, Homo sapiens
  chr17:76211527-76211618
  hypo
agaaagcatatacttcagtgttgttctggatttttttcttcaagatgcctagttaatgacaatgaaattctgtactcggatggtatctgtc

SEQ ID NO: 1625 - DNA, 309 bp, Homo sapiens
  chr17:79769384-79769693
  hypo
cagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 1626 - DNA, 67 bp, Homo sapiens
  chr17:80797692-80797759
  hypo
aaggcagagcagacacggagcaaacgctgcgttcagctgggtattttagatacgtctgagaagagtt

SEQ ID NO: 1627 - DNA, 723 bp, Homo sapiens
  chr17:80797997-80798720
  hypo
tgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 1628 - DNA, 30 bp, Homo sapiens
  chr18:77329727-77329757
  hypo
cagtacaacaggacacgctctcaccttcac

SEQ ID NO: 1629 - DNA, 632 bp, Homo sapiens
  chr19:883582-884214
  hypo
ggcatgtgtgtgagacgtggctctcgggcgggtaacagctgggccagcaggtgaggacggctgcaggagacgaggaggagtgtcggagcccaggactgcccagtggcttggctgtgggcagatggtagacacagacgtgcccagcgggggcaccgggcagtgaaggtgcaggtctgtgcagccacacggggtggcgccaggtgctgctgcaggagccagcgcagcccaaactgcctggtgactcaccacgaggcccaggggaaggaatgaggcccaacaaggccctggggaccgggcgaaggaacgagccctgggagaaggaatggcagcagccctcttcacctgcctggtgactcactacaagccctgggggaaggaatggcagtggccctcttcacctttactgcctctgcggccacaatgggcagttgacataaccacctgcaggccccgggagccatcggggcctcttgacacgtgctcattagtggcttctgaggagcgcctgccccacctgccccacgtgcccccacgtctggccactccagggtccattagcgctaatcggcaaatgcctgtgctctcatctaccgggaaaacatctcccttctccagagcggaggccagcctaa

SEQ ID NO: 1630 - DNA, 460 bp, Homo sapiens
  chr19:1004981-1005441
  hypo
cttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaac

SEQ ID NO: 1631 - DNA, 261 bp, Homo sapiens
  chr19:1808152-1808413
  hypo
cacagacaaacacatcgatgctgccaggtggctaggggggacttcctggaggaggcaacacgcctcacctgcaggatgatgatgatgaggaagaacaggttggacacgcggtggaactgctcgtacaggttcagcggcaggaacgagtagaagttgtacttggccgtgcggatgacattggtctggaacgagagccgcgggctgcctggcagaggggtgccatccaggccaggggatgggggtgcccgaggccagacctgc

SEQ ID NO: 1632 - DNA, 216 bp, Homo sapiens
  chr19:4555896-4556112
  hypo
ctggaggaggtgacacggcctggggaaaagccatggccagcggaggtcgggcgagcagaggcctggaggttggacctggggcgcagggagtctgaagactcacgctgtagttggcgcacaccgggttgaaggcgttggaaccgcacacaaagagcgtggactcgtcccgaaggagcagcacctttacgaagtttcgacactcgccctgaggtgggg

SEQ ID NO: 1633 - DNA, 41 bp, Homo sapiens
  chr19:10231201-10231242
  hypo
cagcctggggctgcagagtgagactccgtctcagaaaaata

SEQ ID NO: 1634 - DNA, 557 bp, Homo sapiens
  chr19:18989724-18990281
  hypo
ccctccacactcactcggctttgctgggcttcaggctctgggcctcggctgtgtcatactcccgcaggtccttcagctcgtgcacctggcctgtcaacaccttggctgcaaacgccacgatgtactgcgagaggggaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagggggacggtgccctacccagtccctgtcctatcccgtcctagacccacc

SEQ ID NO: 1635 - DNA, 120 bp, Homo sapiens
  chr19:41881475-41881595
  hypo
cccggcccgtgagcccgtttctttatctgcaaaacagggattaaaaacaagccaacaccccttcagcactcctccgcaaaaaaacaccccaaaacaaaataggccaggcgcggtgactca

SEQ ID NO: 1636 - DNA, 43 bp, Homo sapiens
  chr20:3027758-3027801
  hypo
aagggtggctgggagcggtggttcacgcctgtaatcccagtac

SEQ ID NO: 1637 - DNA, 102 bp, Homo sapiens
  chr20:42218592-42218694
  hypo
cgcccggcccgtctccacttttaaaatttccagtgacagaaattgtggaaagcaacacgagttgtatgtgttttaatatcctagattcgaagacaaacataa

SEQ ID NO: 1638 - DNA, 343 bp, Homo sapiens
  chr20:49261761-49262104
  hypo
gagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagc

SEQ ID NO: 1639 - DNA, 212 bp, Homo sapiens
  chr20:49346547-49346759
  hypo
acccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcaggga

SEQ ID NO: 1640 - DNA, 26 bp, Homo sapiens
  chr20:49350870-49350896
  hypo
aactaggtagtgtgccggtccttttt

SEQ ID NO: 1641 - DNA, 309 bp, Homo sapiens
  chr20:62046201-62046510
  hypo
caccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacaga

SEQ ID NO: 1642 - DNA, 86 bp, Homo sapiens
  chr20:62115180-62115266
  hypo
tgggcgacagagcgagactcaaaaaaaaaaaaaaaaattattcaccaacccaagtagggtggagctccttccgccacccatgccct

SEQ ID NO: 1643 - DNA, 16 bp, Homo sapiens
  chr22:18110631-18110647
  hypo
acgaccttgtcaaaac

SEQ ID NO: 1644 - DNA, 410 bp, Homo sapiens
  chr22:50899279-50899689
  hypo
tcacacgaaggcaagcgcttgtgtaaactcgaaatctcagtggctgtgagctgaggcctgggtttgcaaggcacacccaagacacggacttgagggccggcgccccaaggaaaggacaaggacccaaagaccgcacatcaaacagtggacatcaactcaagagccacagtgagggccccagacatgcaagcgtaacaacagggccactgctggagactggcctaaaaatggttcatacaagaaagaccggtttgcaggagaaagaccagggcgggggatgagagccccacccgcgcaccgcgccccacctggaatgtgcaggagcgcagctggagcccgtcctgcaggagctggtccacaggggtctggacgctgatgcgcttctccttggtcagcgcagccaccgggaa

SEQ ID NO: 1645 - DNA, 107 bp, Homo sapiens
  chr1:1475537-1475644
  hyper
ggccggggaggggagcgcaggccggggaggggagcgcaggccgcacgggcggtaaacaaggcgcgggaggtgggccaggcggcgcgcgcgggcggggagcagggggc

SEQ ID NO: 1646 - DNA, 611 bp, Homo sapiens
  chr1:2374994-2375605
  hyper
aaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgag

SEQ ID NO: 1647 - DNA, 98 bp, Homo sapiens; identical to SEQ ID NO: 1
  chr1:3567247-3567345
  hyper

SEQ ID NO: 1648 - DNA, 114 bp, Homo sapiens; identical to SEQ ID NO: 2
  chr1:3567737-3567851
  hyper

SEQ ID NO: 1649 - DNA, 395 bp, Homo sapiens; identical to SEQ ID NO: 3
  chr1:3567882-3568277
  hyper

SEQ ID NO: 1650 - DNA, 113 bp, Homo sapiens; identical to SEQ ID NO: 4
  chr1:4715427-4715540
  hyper

SEQ ID NO: 1651 - DNA, 528 bp, Homo sapiens; identical to SEQ ID NO: 5
  chr1:4715574-4716102
  hyper

SEQ ID NO: 1652 - DNA, 517 bp, Homo sapiens; identical to SEQ ID NO: 6
  chr1:6480368-6480885
  hyper

SEQ ID NO: 1653 - DNA, 15 bp, Homo sapiens
  chr1:6500973-6500988
  hyper
ctcactgcgtgcccc

SEQ ID NO: 1654 - DNA, 125 bp, Homo sapiens; identical to SEQ ID NO: 8
  chr1:6501054-6501179
  hyper

SEQ ID NO: 1655 - DNA, 30 bp, Homo sapiens; identical to SEQ ID NO: 9
  chr1:8277113-8277143
  hyper

SEQ ID NO: 1656 - DNA, 50 bp, Homo sapiens; identical to SEQ ID NO: 10
  chr1:11540129-11540179
  hyper

SEQ ID NO: 1657 - DNA, 133 bp, Homo sapiens; identical to SEQ ID NO: 11
  chr1:12123421-12123554
  hyper

SEQ ID NO: 1658 - DNA, 15 bp, Homo sapiens
  chr1:12123787-12123802
  hyper
cgcaagggaggacac

SEQ ID NO: 1659 - DNA, 368 bp, Homo sapiens
  chr1:13910330-13910698
  hyper
gcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagc

SEQ ID NO: 1660 - DNA, 13 bp, Homo sapiens
  chr1:13910699-13910712
  hyper
cgggggagctgag

SEQ ID NO: 1661 - DNA, 127 bp, Homo sapiens
  chr1:14925923-14926050
  hyper
gtgcacggggtcacacggtcacaccggccccggccagcctgagcgaggcgcagccggcgggtcccttccggcatcagaaagtgccctttccgtggcaccagccccctagctccgtgcaaacttttca

SEQ ID NO: 1662 - DNA, 229 bp, Homo sapiens; identical to SEQ ID NO: 13
  chr1:18437202-18437431
  hyper

SEQ ID NO: 1663 - DNA, 94 bp, Homo sapiens; identical to SEQ ID NO: 14
  chr1:18437432-18437526
  hyper

SEQ ID NO: 1664 - DNA, 476 bp, Homo sapiens; identical to SEQ ID NO: 15
  chr1:18956811-18957287
  hyper

SEQ ID NO: 1665 - DNA, 93 bp, Homo sapiens; identical to SEQ ID NO: 16
  chr1:18960897-18960990
  hyper

SEQ ID NO: 1666 - DNA, 331 bp, Homo sapiens; identical to SEQ ID NO: 17
  chr1:22140683-22141014
  hyper

SEQ ID NO: 1667 - DNA, 287 bp, Homo sapiens; identical to SEQ ID NO: 18
  chr1:22141015-22141302
  hyper

SEQ ID NO: 1668 - DNA, 425 bp, Homo sapiens
  chr1:29586066-29586491
  hyper
cctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgta

SEQ ID NO: 1669 - DNA, 124 bp, Homo sapiens
  chr1:30815454-30815578
  hyper
cggcaggtccttgcagaggaggggctcttcccaggagggcgctccagccgaggcccctctgccttcacctgcgccatgaccacttccctcggccctctcccctcctccacgcctcctggggccg

SEQ ID NO: 1670 - DNA, 15 bp, Homo sapiens
  chr1:32237531-32237546
  hyper
cccaccgccggaagc

SEQ ID NO: 1671 - DNA, 1008 bp, Homo sapiens; identical to SEQ ID NO: 20
  chr1:32237638-32238646
  hyper

SEQ ID NO: 1672 - DNA, 741 bp, Homo sapiens
  chr1:34630245-34630986
  hyper
cccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgc

SEQ ID NO: 1673 - DNA, 940 bp, Homo sapiens; identical to SEQ ID NO: 21
  chr1:36042549-36043489
  hyper

SEQ ID NO: 1674 - DNA, 92 bp, Homo sapiens
  chr1:37498753-37498845
  hyper
aacaaagttaaagaccggagtaagagtctccggcgagaagagacgcggagaagccggagccccggaaagccgcgcgcagccccgccagccgc

SEQ ID NO: 1675 - DNA, 200 bp, Homo sapiens
  chr1:37498888-37499088
  hyper
cgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagag

SEQ ID NO: 1676 - DNA, 223 bp, Homo sapiens
  chr1:37499460-37499683
  hyper
gctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactc

SEQ ID NO: 1677 - DNA, 142 bp, Homo sapiens
  chr1:37500013-37500155
  hyper
gggctcccacctgccccggctgccgggctctggcgggcgggctgcacgcgtctccggccgctcctcctccagccgccgccgatgctatcgcccgggctcgcacaaagccccggagtggagttgcacgcgcgcacactctccc

SEQ ID NO: 1678 - DNA, 162 bp, Homo sapiens; identical to SEQ ID NO: 22
  chr1:38510087-38510249
  hyper

SEQ ID NO: 1679 - DNA, 425 bp, Homo sapiens; identical to SEQ ID NO: 23
  chr1:38510309-38510734
  hyper

SEQ ID NO: 1680 - DNA, 160 bp, Homo sapiens; identical to SEQ ID NO: 24
  chr1:38510773-38510933
  hyper

SEQ ID NO: 1681 - DNA, 866 bp, Homo sapiens; identical to SEQ ID NO: 25
  chr1:38510934-38511800
  hyper

SEQ ID NO: 1682 - DNA, 269 bp, Homo sapiens; identical to SEQ ID NO: 26
  chr1:38511821-38512090
  hyper

SEQ ID NO: 1683 - DNA, 478 bp, Homo sapiens
  chr1:39269643-39270121
  hyper
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggt

SEQ ID NO: 1684 - DNA, 120 bp, Homo sapiens
  chr1:40237083-40237203
  hyper
caacagggagggggccggctccgccctgggctgggggcccccgagtcagtcctccgtgtccagcgcacaggcccgggcgcaggacagagctgaggtcaggctccgcgagaagggcacagg

SEQ ID NO: 1685 - DNA, 428 bp, Homo sapiens
  chr1:41284168-41284596
  hyper
ccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggct

SEQ ID NO: 1686 - DNA, 141 bp, Homo sapiens; identical to SEQ ID NO: 27
  chr1:44872582-44872723
  hyper

SEQ ID NO: 1687 - DNA, 141 bp, Homo sapiens; identical to SEQ ID NO: 28
  chr1:44872923-44873064
  hyper

SEQ ID NO: 1688 - DNA, 108 bp, Homo sapiens; identical to SEQ ID NO: 29
  chr1:44873065-44873173
  hyper

SEQ ID NO: 1689 - DNA, 281 bp, Homo sapiens; identical to SEQ ID NO: 30
  chr1:44873509-44873790
  hyper

SEQ ID NO: 1690 - DNA, 94 bp, Homo sapiens; identical to SEQ ID NO: 31
  chr1:44883121-44883215
  hyper

SEQ ID NO: 1691 - DNA, 95 bp, Homo sapiens; identical to SEQ ID NO: 32
  chr1:44883751-44883846
  hyper

SEQ ID NO: 1692 - DNA, 40 bp, Homo sapiens
  chr1:46913837-46913877
  hyper
accgcccggcctttgcgtccggcccagctcaagccccttc

SEQ ID NO: 1693 - DNA, 360 bp, Homo sapiens
  chr1:46913886-46914246
  hyper
cggcctcgggagcgctgggcaggcagcccgggtgggagcgcccacgtctcccgcggacacggacggacggatggacgggcggccgcgcaggcccgcgccccgctcccgccccgcctgccgcgcctcccggggcgcccgcattaaagcgcatatgcaagccatgaattatcaactgaaaggagtcaattaccggctctaaaaacgagtgtctgcgctcgcagcgccccgggccatccgcctatttacggagcgatctaccccgcccggctggggagggggcctcgggagggagagagacggagaaacggagcccgagaccgggagagagccggagaggcagggactggagagtctgggaca

SEQ ID NO: 1694 - DNA, 137 bp, Homo sapiens
  chr1:46914285-46914422
  hyper
cgcggagggccggacgggagccaaggcggctcagttcctcttctcccccgagcaggcgaggagaggtggggtctcaggacctccaaggccctgttccccttccattggcatttgtgtaaggacgcaggccctccgca

SEQ ID NO: 1695 - DNA, 122 bp, Homo sapiens
  chr1:46951196-46951318
  hyper
gtagccgtcggagggcggggacagagcggtagctgccttgcgctgggattgggggtgggggtgggagtggggagggctctttaagcggcggccgcgctaataacctgtccaggagatggctc

SEQ ID NO: 1696 - DNA, 95 bp, Homo sapiens
  chr1:46951644-46951739
  hyper
cgcccggaaggggcggggaggggccccggccctcaagccgcacagccaggtgttcccgctcttcgaggacatcccctgcccgcctggaggttgag

SEQ ID NO: 1697 - DNA, 229 bp, Homo sapiens; identical to SEQ ID NO: 33
  chr1:46956387-46956616
  hyper

SEQ ID NO: 1698 - DNA, 155 bp, Homo sapiens; identical to SEQ ID NO: 34
  chr1:46956684-46956839
  hyper

SEQ ID NO: 1699 - DNA, 314 bp, Homo sapiens; identical to SEQ ID NO: 35
  chr1:46956840-46957154
  hyper

SEQ ID NO: 1700 - DNA, 326 bp, Homo sapiens; identical to SEQ ID NO: 36
  chr1:47009560-47009886
  hyper

SEQ ID NO: 1701 - DNA, 126 bp, Homo sapiens; identical to SEQ ID NO: 37
  chr1:47009910-47010036
  hyper

SEQ ID NO: 1702 - DNA, 28 bp, Homo sapiens
  chr1:47010104-47010132
  hyper
cgtccgcactttccgagagccaggcacg

SEQ ID NO: 1703 - DNA, 226 bp, Homo sapiens; identical to SEQ ID NO: 39
  chr1:47696295-47696521
  hyper

SEQ ID NO: 1704 - DNA, 345 bp, Homo sapiens; identical to SEQ ID NO: 40
  chr1:47696620-47696965
  hyper

SEQ ID NO: 1705 - DNA, 44 bp, Homo sapiens; identical to SEQ ID NO: 41
  chr1:47696986-47697030
  hyper

SEQ ID NO: 1706 - DNA, 606 bp, Homo sapiens; identical to SEQ ID NO: 42
  chr1:47697341-47697947
  hyper

SEQ ID NO: 1707 - DNA, 89 bp, Homo sapiens; identical to SEQ ID NO: 43
  chr1:47698006-47698095
  hyper

SEQ ID NO: 1708 - DNA, 370 bp, Homo sapiens
  chr1:47909575-47909945
  hyper
ttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaa

SEQ ID NO: 1709 - DNA, 222 bp, Homo sapiens
  chr1:48059057-48059279
  hyper
gggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctg

SEQ ID NO: 1710 - DNA, 665 bp, Homo sapiens
  chr1:50798652-50799317
  hyper
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggtgacttgggcggaagacggggcgtcagggccgcctgcgcg

SEQ ID NO: 1711 - DNA, 127 bp, Homo sapiens
  chr1:50799393-50799520
  hyper
cggcggcagccgcggctgccccctactggcggaaggaagagtcgccgctccggggcccttggcggccgccgctcttcgcgcctccttggcctggctgccacccttccaccctcgggggagaccccgc

SEQ ID NO: 1712 - DNA, 302 bp, Homo sapiens
  chr1:50880931-50881233
  hyper
cggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccct

SEQ ID NO: 1713 - DNA, 88 bp, Homo sapiens
  chr1:50881869-50881957
  hyper
cttgggaatgagtaacgcgggtccacaggccgccccctcgggtccggccagagcatcggcaggaaccgaggagcctcgggggacccag

SEQ ID NO: 1714 - DNA, 119 bp, Homo sapiens
  chr1:50882143-50882262
  hyper
cgctttctcccgcctgcctcttttctttctaactcttccctctcctgtctcctctcgccctcttttttctccttttttatccccttttcgtccatcgctcttgccggcatctttcttct

SEQ ID NO: 1715 - DNA, 600 bp, Homo sapiens; identical to SEQ ID NO: 44
  chr1:50882808-50883408
  hyper

SEQ ID NO: 1716 - DNA, 15 bp, Homo sapiens
  chr1:50883962-50883977
  hyper
ccatccactgagagc

SEQ ID NO: 1717 - DNA, 333 bp, Homo sapiens; identical to SEQ ID NO: 46
  chr1:50884020-50884353
  hyper

SEQ ID NO: 1718 - DNA, 198 bp, Homo sapiens; identical to SEQ ID NO: 47
  chr1:50884690-50884888
  hyper

SEQ ID NO: 1719 - DNA, 634 bp, Homo sapiens; identical to SEQ ID NO: 48
  chr1:50886451-50887085
  hyper

SEQ ID NO: 1720 - DNA, 60 bp, Homo sapiens; identical to SEQ ID NO: 49
  chr1:50887175-50887235
  hyper

SEQ ID NO: 1721 - DNA, 727 bp, Homo sapiens
  chr1:50889123-50889850
  hyper
cgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaa

SEQ ID NO: 1722 - DNA, 307 bp, Homo sapiens
  chr1:50890061-50890368
  hyper
tttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggt

SEQ ID NO: 1723 - DNA, 152 bp, Homo sapiens
  chr1:50890795-50890947
  hyper
cgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatg

SEQ ID NO: 1724 - DNA, 322 bp, Homo sapiens; identical to SEQ ID NO: 50
  chr1:50891148-50891470
  hyper

SEQ ID NO: 1725 - DNA, 131 bp, Homo sapiens
  chr1:50892153-50892284
  hyper
cacagatttccacctcggtgatagcacacgccgacaggagcacattcttacgcaggtatgccctggtttatgcgcggagctccagtcttacttctacagttgggccccgggcagaaaaagccaaaaccctc

SEQ ID NO: 1726 - DNA, 525 bp, Homo sapiens
  chr1:50892336-50892861
  hyper
cgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctga

SEQ ID NO: 1727 - DNA, 49 bp, Homo sapiens
  chr1:53308559-53308608
  hyper
ttcatttcttgcacccgggccacacgccccggaacatcgtccctcctga

SEQ ID NO: 1728 - DNA, 368 bp, Homo sapiens
  chr1:53308907-53309275
  hyper
cggcgagagcccagtcccagagaccggggcgagcctcctcaggattcctcgccccagtgcgggctgctgtgagcttagacgtaggtgcagggcatggcactcggcttggcccgtagtggacggtgtttttgcagtcatgaacccaaacgccgcaaaccttgaccgtttccccacccgtgttgtggacgcagcgccccgcggaggcggtgaccctttggccgttaccacctgaggcctttgggcccggggccgggcgagtagcttagtccggctgggggaactggaacccgaagtctgagattctttcagttccgcgcgtccgcccccgtccccgtcccgtccccagcctttgccgaatgcctgttact

SEQ ID NO: 1729 - DNA, 504 bp, Homo sapiens; identical to SEQ ID NO: 51
  chr1:54203828-54204332
  hyper

SEQ ID NO: 1730 - DNA, 29 bp, Homo sapiens
  chr1:58715503-58715532
  hyper
cggccacaacttgggcggctctgtgcggc

SEQ ID NO: 1731 - DNA, 322 bp, Homo sapiens; identical to SEQ ID NO: 53
  chr1:58715533-58715855
  hyper

SEQ ID NO: 1732 - DNA, 15 bp, Homo sapiens
  chr1:58715978-58715993
  hyper
cgagcgggctccgct

SEQ ID NO: 1733 - DNA, 342 bp, Homo sapiens; identical to SEQ ID NO: 55
  chr1:63539509-63539851
  hyper

SEQ ID NO: 1734 - DNA, 306 bp, Homo sapiens; identical to SEQ ID NO: 56
  chr1:63784987-63785293
  hyper

SEQ ID NO: 1735 - DNA, 149 bp, Homo sapiens; identical to SEQ ID NO: 57
  chr1:63785618-63785767
  hyper

SEQ ID NO: 1736 - DNA, 251 bp, Homo sapiens; identical to SEQ ID NO: 58
  chr1:63786078-63786329
  hyper

SEQ ID NO: 1737 - DNA, 102 bp, Homo sapiens
  chr1:63786656-63786758
  hyper
gcaccactgtccatccggaattaaatccacatcccagcatcttctgcaaatatttcactaattatttcctctcggaactcctcccctcgtgctccttcctct

SEQ ID NO: 1738 - DNA, 32 bp, Homo sapiens
  chr1:63787031-63787063
  hyper
acttgccttgcactccgcgtgcattggccaca

SEQ ID NO: 1739 - DNA, 280 bp, Homo sapiens; identical to SEQ ID NO: 59
  chr1:63789217-63789497
  hyper

SEQ ID NO: 1740 - DNA, 31 bp, Homo sapiens; identical to SEQ ID NO: 60
  chr1:63789728-63789759
  hyper

SEQ ID NO: 1741 - DNA, 26 bp, Homo sapiens
  chr1:63790252-63790278
  hyper
ggtcccggtcccgctgcccaatcctg

SEQ ID NO: 1742 - DNA, 584 bp, Homo sapiens; identical to SEQ ID NO: 61
  chr1:63795350-63795934
  hyper

SEQ ID NO: 1743 - DNA, 218 bp, Homo sapiens; identical to SEQ ID NO: 62
  chr1:63795935-63796153
  hyper

SEQ ID NO: 1744 - DNA, 462 bp, Homo sapiens; identical to SEQ ID NO: 63
  chr1:66998790-66999252
  hyper

SEQ ID NO: 1745 - DNA, 378 bp, Homo sapiens; identical to SEQ ID NO: 64
  chr1:67217965-67218343
  hyper

SEQ ID NO: 1746 - DNA, 621 bp, Homo sapiens
  chr1:67773159-67773780
  hyper
atcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 1747 - DNA, 502 bp, Homo sapiens
  chr1:70033989-70034491
  hyper
cggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 1748 - DNA, 13 bp, Homo sapiens
  chr1:70034492-70034505
  hyper
gcgaagatgtggt

SEQ ID NO: 1749 - DNA, 151 bp, Homo sapiens; identical to SEQ ID NO: 65
  chr1:75596708-75596859
  hyper

SEQ ID NO: 1750 - DNA, 418 bp, Homo sapiens; identical to SEQ ID NO: 66
  chr1:75596929-75597347
  hyper

SEQ ID NO: 1751 - DNA, 369 bp, Homo sapiens
  chr1:75601983-75602352
  hyper
ttaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaa

SEQ ID NO: 1752 - DNA, 218 bp, Homo sapiens; identical to SEQ ID NO: 67
  chr1:77334168-77334386
  hyper

SEQ ID NO: 1753 - DNA, 119 bp, Homo sapiens; identical to SEQ ID NO: 68
  chr1:77334408-77334527
  hyper

SEQ ID NO: 1754 - DNA, 267 bp, Homo sapiens
  chr1:78957231-78957498
  hyper
cacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctg

SEQ ID NO: 1755 - DNA, 590 bp, Homo sapiens
  chr1:91172087-91172677
  hyper
catgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagta

SEQ ID NO: 1756 - DNA, 417 bp, Homo sapiens; identical to SEQ ID NO: 69
  chr1:91177840-91178257
  hyper

SEQ ID NO: 1757 - DNA, 241 bp, Homo sapiens; identical to SEQ ID NO: 70
  chr1:91181807-91182048
  hyper

SEQ ID NO: 1758 - DNA, 162 bp, Homo sapiens
  chr1:91182320-91182482
  hyper
aattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggct

SEQ ID NO: 1759 - DNA, 139 bp, Homo sapiens
  chr1:91184274-91184413
  hyper
aaatgcctggccagacgctttctcccgaacgggggagctaatgcccgaggcgttctctggtggcgagggcagccacggttcactgcggtgtcgggcgggcgcggggctcaggacccatagcggctggtctgcagcccgc

SEQ ID NO: 1760 - DNA, 73 bp, Homo sapiens
  chr1:91184414-91184487
  hyper
cccctgccgcgccccgcggcagtccgtccacctctgtcccccggcccctttcggcgagcgctcatttggaaag

SEQ ID NO: 1761 - DNA, 119 bp, Homo sapiens
  chr1:91185190-91185309
  hyper
aggagatgcacaatccgggcagctctcgctcttctcggaaggcgaagggagtttggcggagaagacggggttggtgagccgaggcggggactccggacgtgctccatcccggcaggggc

SEQ ID NO: 1762 - DNA, 230 bp, Homo sapiens
  chr1:91185347-91185577
  hyper
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcg

SEQ ID NO: 1763 - DNA, 481 bp, Homo sapiens; identical to SEQ ID NO: 71
  chr1:91188983-91189464
  hyper

SEQ ID NO: 1764 - DNA, 269 bp, Homo sapiens; identical to SEQ ID NO: 72
  chr1:91190137-91190406
  hyper

SEQ ID NO: 1765 - DNA, 80 bp, Homo sapiens
  chr1:91190869-91190949
  hyper
tgggcttgtaaaagacgcttccgcagagcaggtcccgtcagggtctttttcctgttcctggtgccagcggtcggcccggg

SEQ ID NO: 1766 - DNA, 17 bp, Homo sapiens
  chr1:91190984-91191001
  hyper
cggagagtgcccctccc

SEQ ID NO: 1767 - DNA, 233 bp, Homo sapiens
  chr1:91191002-91191235
  hyper
caggcgccgtggcgagatcactctgaatatgtaacatatttgtaacgtgcgccgaggtgtgatgtgtgtgctgaaatagggggatgggggaattcgaagccggattgggaaggcgggggggaggcgcacagaactcacaatgtacttcgcaatctaacaatctgaacattcatttattaaaagctgctgcgtgacatttacactgagccaccagtctctgcctctaatccggg

SEQ ID NO: 1768 - DNA, 249 bp, Homo sapiens
  chr1:91191289-91191538
  hyper
cgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctg

SEQ ID NO: 1769 - DNA, 233 bp, Homo sapiens; identical to SEQ ID NO: 73
  chr1:91192344-91192577
  hyper

SEQ ID NO: 1770 - DNA, 54 bp, Homo sapiens; identical to SEQ ID NO: 74
  chr1:91192681-91192735
  hyper

SEQ ID NO: 1771 - DNA, 242 bp, Homo sapiens; identical to SEQ ID NO: 75
  chr1:91195148-91195390
  hyper

SEQ ID NO: 1772 - DNA, 71 bp, Homo sapiens
  chr1:91316261-91316332
  hyper
gccggctttgggcaccgggggtgggggctacgctacgcgtgaagggcctcagtcctcgggctttagttcag

SEQ ID NO: 1773 - DNA, 146 bp, Homo sapiens
  chr1:92948451-92948597
  hyper
gaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaag

SEQ ID NO: 1774 - DNA, 135 bp, Homo sapiens
  chr1:92952304-92952439
  hyper
ttgctcatttcccttcggatttaggtaatggttaaatttggaagaggtgggcgagcgccgagcccccggcggagagggccctggcggcgcgtcccgcgggcgcccggcgggaccggtgggcgcaccctccctgcg

SEQ ID NO: 1775 - DNA, 307 bp, Homo sapiens
  chr1:98511359-98511666
  hyper
ggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaa

SEQ ID NO: 1776 - DNA, 361 bp, Homo sapiens
  chr1:101004456-101004817
  hyper
agtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctg

SEQ ID NO: 1777 - DNA, 653 bp, Homo sapiens
  chr1:101005071-101005724
  hyper
ggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtcc

SEQ ID NO: 1778 - DNA, 604 bp, Homo sapiens
  chr1:107683171-107683775
  hyper
ttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 1779 - DNA, 13 bp, Homo sapiens
  chr1:107683776-107683789
  hyper
gggagtggcgggc

SEQ ID NO: 1780 - DNA, 450 bp, Homo sapiens; identical to SEQ ID NO: 76
  chr1:108506627-108507077
  hyper

SEQ ID NO: 1781 - DNA, 228 bp, Homo sapiens; identical to SEQ ID NO: 77
  chr1:108507148-108507376
  hyper

SEQ ID NO: 1782 - DNA, 113 bp, Homo sapiens; identical to SEQ ID NO: 78
  chr1:108507494-108507607
  hyper

SEQ ID NO: 1783 - DNA, 550 bp, Homo sapiens; identical to SEQ ID NO: 79
  chr1:108507657-108508207
  hyper

SEQ ID NO: 1784 - DNA, 340 bp, Homo sapiens; identical to SEQ ID NO: 80
  chr1:108508208-108508548
  hyper

SEQ ID NO: 1785 - DNA, 38 bp, Homo sapiens; identical to SEQ ID NO: 81
  chr1:108508549-108508587
  hyper

SEQ ID NO: 1786 - DNA, 312 bp, Homo sapiens; identical to SEQ ID NO: 82
  chr1:110610586-110610898
  hyper

SEQ ID NO: 1787 - DNA, 232 bp, Homo sapiens; identical to SEQ ID NO: 83
  chr1:110611045-110611277
  hyper

SEQ ID NO: 1788 - DNA, 80 bp, Homo sapiens; identical to SEQ ID NO: 84
  chr1:110611434-110611514
  hyper

SEQ ID NO: 1789 - DNA, 141 bp, Homo sapiens; identical to SEQ ID NO: 85
  chr1:110611653-110611794
  hyper

SEQ ID NO: 1790 - DNA, 128 bp, Homo sapiens
  chr1:110626790-110626918
  hyper
ccctcgcgtggccgggcgcagatccccgtgcacgggtcctccgcacacccttgccagcccgcagggattgttcgccgcgttggtgactccttcccaaaatgggaataaaagatcgaaatagctagtaa

SEQ ID NO: 1791 - DNA, 480 bp, Homo sapiens
  chr1:110627133-110627613
  hyper
aatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcag

SEQ ID NO: 1792 - DNA, 595 bp, Homo sapiens; identical to SEQ ID NO: 86
  chr1:110692902-110693497
  hyper

SEQ ID NO: 1793 - DNA, 433 bp, Homo sapiens; identical to SEQ ID NO: 87
  chr1:110693736-110694169
  hyper

SEQ ID NO: 1794 - DNA, 295 bp, Homo sapiens
  chr1:111097952-111098247
  hyper
ataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggc

SEQ ID NO: 1795 - DNA, 239 bp, Homo sapiens; identical to SEQ ID NO: 88
  chr1:111216734-111216973
  hyper

SEQ ID NO: 1796 - DNA, 381 bp, Homo sapiens; identical to SEQ ID NO: 89
  chr1:111217194-111217575
  hyper

SEQ ID NO: 1797 - DNA, 136 bp, Homo sapiens; identical to SEQ ID NO: 90
  chr1:111217576-111217712
  hyper

SEQ ID NO: 1798 - DNA, 179 bp, Homo sapiens; identical to SEQ ID NO: 91
  chr1:111217713-111217892
  hyper

SEQ ID NO: 1799 - DNA, 93 bp, Homo sapiens; identical to SEQ ID NO: 92
  chr1:111217923-111218016
  hyper

SEQ ID NO: 1800 - DNA, 366 bp, Homo sapiens
  chr1:114695329-114695695
  hyper
gagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacaccc

SEQ ID NO: 1801 - DNA, 41 bp, Homo sapiens
  chr1:114695696-114695737
  hyper
gacacaaagacctcgtgccagccgcagacccaagtttctcc

SEQ ID NO: 1802 - DNA, 310 bp, Homo sapiens
  chr1:114695799-114696109
  hyper
cgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctccca

SEQ ID NO: 1803 - DNA, 138 bp, Homo sapiens
  chr1:116371049-116371187
  hyper
ggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 1804 - DNA, 13 bp, Homo sapiens
  chr1:116371188-116371201
  hyper
tcagtcaattcag

SEQ ID NO: 1805 - DNA, 144 bp, Homo sapiens
  chr1:119530005-119530149
  hyper
cgacgaaaatgcaaggctcagtccagccccaaaaattggttccggtgaatttagggaggctcagggcatttgcgcgaagaaacagaaacctatgttggggcaaggcagggcgtcaatggcagggcctagctcctcacccgcgac

SEQ ID NO: 1806 - DNA, 307 bp, Homo sapiens
  chr1:119530201-119530508
  hyper
cgacgcactcacccgggtgaggctccaggccgtgtgccgccgcgtcctccgtgtctccgagtgggcccgcggggctcagcgcctccatagacaggtccagccccttctcctcccagtctcgcagtttccgttttttatttgagccgatcaaggcttcaacggagaaggcatgtgctcgcgagctcagggcgactgcagatcttctcctttcactcattttagccgcccacacccctgcctccgcttgcccccgctaccgagggagcagccggcgccctcaagctctgagcgcccaccgggcccggcc

SEQ ID NO: 1807 - DNA, 47 bp, Homo sapiens
  chr1:119530553-119530600
  hyper
cgggtctctccaccctccccctgcgtcctcctccgccctcctctgcc

SEQ ID NO: 1808 - DNA, 124 bp, Homo sapiens
  chr1:119530601-119530725
  hyper
gatccgacctgcgcccctacgctggcccagctgctaggaactagcgccccgagcgccgcccgctcgctgcatgagcgcccgagtcctgcttcccacccaccggggcaggcgctcacagactgtg

SEQ ID NO: 1809 - DNA, 93 bp, Homo sapiens
  chr1:119531021-119531114
  hyper
gaacaagagaaactccgagagcgcgaaccaatgagaggaagggagagactgaggcccgggccaaagcgcagcgccagtcgtcccctggatgct

SEQ ID NO: 1810 - DNA, 487 bp, Homo sapiens
  chr1:119543532-119544019
  hyper
taaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgaggggg

SEQ ID NO: 1811 - DNA, 606 bp, Homo sapiens
  chr1:119549129-119549735
  hyper
agcctcaatcttaaccgcgtatgatcgtttccactgcacctgtgcgggagagacaggcgcatatccccgtggcgtcggatctctaaattatctaatctggcggctgcgtacgactcagggaaagccctggccgcgagctttttcaccaggcttgagctcagcagccgggcccgcagtgttgccgccagtggggaggcagggaggctgtcggcgcgccggagccaggcgggaaagggactacagccgcccgccgttgtagcgcaggaagcgggcggtgccaacacacacctcgcagctctgcacgttcttcgtgtcttggaggagagtagagcctccgtgtgaagctccgtccgcacctgacgaagaggagggcgtcttgcgccactccagcgactctgcgatgttaagacgcagacccgctgctgcgcctgcctttgtcggggcgggcgggcagccgccgctcggagcaaggtggggctgcggggagggagagccgcggggcagatccctggccaaggtcctctagaaagcccgctctgcgcccaaacgcgccgctcggtccgtgggccacttcggacctgacgctgccggtgaattcacgcgctc

SEQ ID NO: 1812 - DNA, 15 bp, Homo sapiens
  chr1:119549914-119549929
  hyper
cgtctaccccaaccc

SEQ ID NO: 1813 - DNA, 285 bp, Homo sapiens; identical to SEQ ID NO: 93
  chr1:119551013-119551298
  hyper

SEQ ID NO: 1814 - DNA, 337 bp, Homo sapiens
  chr1:151694069-151694406
  hyper
cagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 1815 - DNA, 297 bp, Homo sapiens
  chr1:153651898-153652195
  hyper
gtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgtt

SEQ ID NO: 1816 - DNA, 15 bp, Homo sapiens
  chr1:154474763-154474778
  hyper
tgctctttcctcctg

SEQ ID NO: 1817 - DNA, 81 bp, Homo sapiens; identical to SEQ ID NO: 95
  chr1:154474987-154475068
  hyper

SEQ ID NO: 1818 - DNA, 173 bp, Homo sapiens; identical to SEQ ID NO: 96
  chr1:154475371-154475544
  hyper

SEQ ID NO: 1819 - DNA, 662 bp, Homo sapiens; identical to SEQ ID NO: 97
  chr1:156357865-156358527
  hyper

SEQ ID NO: 1820 - DNA, 714 bp, Homo sapiens; identical to SEQ ID NO: 98
  chr1:156390135-156390849
  hyper

SEQ ID NO: 1821 - DNA, 48 bp, Homo sapiens
  chr1:156405367-156405415
  hyper
cgccggcagggcccccgaggcgcctctgcctgctctctccgttcttgc

SEQ ID NO: 1822 - DNA, 437 bp, Homo sapiens
  chr1:156405634-156406071
  hyper
cgcgggctccggagctgaggtgagaagtgagcagaaagtgaaaagagaatccatcggaaacagataaaaaaggaaaaacaaaacccactcgaaaagaaagaaaacgttacaacaaaaaggataaagtaacgctaaatgaaataaaaaggagacatactaaaaacgttaaagttgttaaactaagtgatagaaaaggcgaagaaacaacagggctaggaaagggctccgaggcgcccgcagggaagggggccctagacggggcgatgaggcttttgggagcctccggccgcgggcgcggcggggtccggcgggtgcgcagcggccggggctcctccgcgcgctgcccgccgccggcacccggctcgggcgaagagccggctggacggtcagccagccccacccacagagagtcgcgggagcccgagggccgggagctg

SEQ ID NO: 1823 - DNA, 327 bp, Homo sapiens
  chr1:156406104-156406431
  hyper
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaa

SEQ ID NO: 1824 - DNA, 20 bp, Homo sapiens
  chr1:156814933-156814953
  hyper
tgcaggcatggatgtcgatc

SEQ ID NO: 1825 - DNA, 210 bp, Homo sapiens
  chr1:156815030-156815240
  hyper
cgagctgttgccccccagccggaggggcccagctgcccggcggtgccgccctgagtccctggggagagcgagtcagagccaaggcccagcccccaaagccacgcccctcagcacctgccctagtcctgctcacctttgggggctcttgttgatggacgtcaccttccaaggggatctggggaggccaggagtagccctatcaggcctgtc

SEQ ID NO: 1826 - DNA, 425 bp, Homo sapiens; identical to SEQ ID NO: 99
  chr1:156863061-156863486
  hyper

SEQ ID NO: 1827 - DNA, 69 bp, Homo sapiens; identical to SEQ ID NO: 100
  chr1:156863640-156863709
  hyper

SEQ ID NO: 1828 - DNA, 44 bp, Homo sapiens
  chr1:158150605-158150649
  hyper
caggaaattgagacacgccggttgtgaaacctactgaagtgagc

SEQ ID NO: 1829 - DNA, 147 bp, Homo sapiens
  chr1:158150650-158150797
  hyper
gcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagc

SEQ ID NO: 1830 - DNA, 104 bp, Homo sapiens
  chr1:158150798-158150902
  hyper
gaaagggacgtgagctgagcggcgggggagaagagtgcgcaggtcagagggcggcgcgcagcggcgctccgcgaggtccccacgccgggcgatatggggtgcct

SEQ ID NO: 1831 - DNA, 36 bp, Homo sapiens
  chr1:159158333-159158369
  hyper
ctggcgaagttcacccgggactccaaagcccggaca

SEQ ID NO: 1832 - DNA, 40 bp, Homo sapiens
  chr1:159158471-159158511
  hyper
cgcaaggccggtttctttgtccctccgcctcttcaggttg

SEQ ID NO: 1833 - DNA, 438 bp, Homo sapiens
  chr1:161275639-161276077
  hyper
cgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatggggga

SEQ ID NO: 1834 - DNA, 56 bp, Homo sapiens
  chr1:165324488-165324544
  hyper
cggctttggggaattcggtgcccagtgcgtgaggcctggggcggcttgttggattt

SEQ ID NO: 1835 - DNA, 489 bp, Homo sapiens
  chr1:165325716-165326205
  hyper
cgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 1836 - DNA, 173 bp, Homo sapiens
  chr1:165326296-165326469
  hyper
cgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatg

SEQ ID NO: 1837 - DNA, 636 bp, Homo sapiens
  chr1:167599216-167599852
  hyper
gagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccac

SEQ ID NO: 1838 - DNA, 278 bp, Homo sapiens; identical to SEQ ID NO: 101
  chr1:169396357-169396635
  hyper

SEQ ID NO: 1839 - DNA, 53 bp, Homo sapiens; identical to SEQ ID NO: 102
  chr1:169396636-169396689
  hyper

SEQ ID NO: 1840 - DNA, 193 bp, Homo sapiens; identical to SEQ ID NO: 103
  chr1:169396730-169396923
  hyper

SEQ ID NO: 1841 - DNA, 144 bp, Homo sapiens; identical to SEQ ID NO: 104
  chr1:170630458-170630602
  hyper

SEQ ID NO: 1842 - DNA, 207 bp, Homo sapiens; identical to SEQ ID NO: 105
  chr1:170630603-170630810
  hyper

SEQ ID NO: 1843 - DNA, 595 bp, Homo sapiens; identical to SEQ ID NO: 106
  chr1:171810200-171810795
  hyper

SEQ ID NO: 1844 - DNA, 376 bp, Homo sapiens
  chr1:177140304-177140680
  hyper
cgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacac

SEQ ID NO: 1845 - DNA, 499 bp, Homo sapiens
  chr1:180202658-180203157
  hyper
ccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactg

SEQ ID NO: 1846 - DNA, 243 bp, Homo sapiens
  chr1:180203365-180203608
  hyper
gattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaag

SEQ ID NO: 1847 - DNA, 588 bp, Homo sapiens
  chr1:180203633-180204221
  hyper
cggatggctgaggactcccaaggggcgagagggctccggcctcctcctttccagggccttgttatctgagagggccgttagcacggagggaagcttggaaagccgctgtcccagtgcgctccgcatgcggaattaactgttaaagccggacacggagcacgcaggtgcagcaggtgaggggcaaaggtctgcattgagcagtccgcagtgtcccgggaagtcgtaaagtcgggactgagaagaagcaggacctaactcaagtttatttcctctcttggccgaggtccgggctcgtggaaaaccagagctaggcggggctacgcagggctgagcaggagtggcgtcctagggtctgggagcgcgacccacatgacctcgctacgaccggggcagggctcctccgccccgcgggcagatgccggcctgggtggcccggggaacagacgatgaattctttaaatgagcgtttgctgcgcacccatgggcggctcacgatcctgggcactcgcccgggaatcccgggcgtgctctgggttttgggggactcgccggtggaggtagatgtggacagggcggccggcccttcgc

SEQ ID NO: 1848 - DNA, 398 bp, Homo sapiens
  chr1:180204222-180204620
  hyper
ggtagccggctttgcgcttactgcgtcccgcagcggtgggtaaaggtcgtagcccagaaggggacaagggagggaccgcctctctctccccggtgcgctgcaatagaggttcctgcgccttggcccttgcagtccatccgcccagaggttcgcgcccgttttcggagcttattatctcaggtagcccagaggtccgactgagctggaattagccaggcctgggacccctttgctgccctttagagtggtggcagggacttttccagcaaggataggcgcggcaggcgcgagtgcggacggcgcgcccattaggaggaggccgggtgaaaacctctcttcctctccagacccatttcgttccaagcatttggaatgacaaaattaaaccccaaccctgg

SEQ ID NO: 1849 - DNA, 18 bp, Homo sapiens
  chr1:180204897-180204915
  hyper
cgccggggaaggcgaggt

SEQ ID NO: 1850 - DNA, 64 bp, Homo sapiens
  chr1:181288138-181288202
  hyper
gagacactaacccaccgacgtctcccttgagatcgcggcttcctccttgcgcagaggactgagg

SEQ ID NO: 1851 - DNA, 978 bp, Homo sapiens
  chr1:181451381-181452359
  hyper
gacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 1852 - DNA, 334 bp, Homo sapiens
  chr1:183387266-183387600
  hyper
gggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgt

SEQ ID NO: 1853 - DNA, 16 bp, Homo sapiens
  chr1:190445181-190445197
  hyper
cacagtctcaaccccc

SEQ ID NO: 1854 - DNA, 23 bp, Homo sapiens
  chr1:190445198-190445221
  hyper
ttccctctcggtgggagtcaagg

SEQ ID NO: 1855 - DNA, 62 bp, Homo sapiens; identical to SEQ ID NO: 107
  chr1:197879599-197879661
  hyper

SEQ ID NO: 1856 - DNA, 508 bp, Homo sapiens; identical to SEQ ID NO: 108
  chr1:197879716-197880224
  hyper

SEQ ID NO: 1857 - DNA, 160 bp, Homo sapiens; identical to SEQ ID NO: 109
  chr1:197886907-197887067
  hyper

SEQ ID NO: 1858 - DNA, 311 bp, Homo sapiens; identical to SEQ ID NO: 110
  chr1:197887146-197887457
  hyper

SEQ ID NO: 1859 - DNA, 416 bp, Homo sapiens; identical to SEQ ID NO: 111
  chr1:197887706-197888122
  hyper

SEQ ID NO: 1860 - DNA, 45 bp, Homo sapiens; identical to SEQ ID NO: 112
  chr1:197888180-197888225
  hyper

SEQ ID NO: 1861 - DNA, 299 bp, Homo sapiens; identical to SEQ ID NO: 113
  chr1:200009750-200010049
  hyper

SEQ ID NO: 1862 - DNA, 361 bp, Homo sapiens
  chr1:200011323-200011684
  hyper
tggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaac

SEQ ID NO: 1863 - DNA, 383 bp, Homo sapiens
  chr1:200011685-200012068
  hyper
ccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgt

SEQ ID NO: 1864 - DNA, 227 bp, Homo sapiens
  chr1:204653792-204654019
  hyper
cgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgcc

SEQ ID NO: 1865 - DNA, 376 bp, Homo sapiens; identical to SEQ ID NO: 114
  chr1:205312536-205312912
  hyper

SEQ ID NO: 1866 - DNA, 357 bp, Homo sapiens
  chr1:205424654-205425011
  hyper
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggca

SEQ ID NO: 1867 - DNA, 407 bp, Homo sapiens; identical to SEQ ID NO: 115
  chr1:207669381-207669788
  hyper

SEQ ID NO: 1868 - DNA, 232 bp, Homo sapiens; identical to SEQ ID NO: 116
  chr1:207669828-207670060
  hyper

SEQ ID NO: 1869 - DNA, 224 bp, Homo sapiens
  chr1:208084174-208084398
  hyper
agctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccc

SEQ ID NO: 1870 - DNA, 239 bp, Homo sapiens
  chr1:214156419-214156658
  hyper
ccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacac

SEQ ID NO: 1871 - DNA, 84 bp, Homo sapiens
  chr1:214158827-214158911
  hyper
gctcctatttcaagtcgccgctcctgcgccctaatgcgggctgcgaaccgccgcggcagagcgtcgcgagccgggagcctctgc

SEQ ID NO: 1872 - DNA, 810 bp, Homo sapiens; identical to SEQ ID NO: 117
  chr1:215255060-215255870
  hyper

SEQ ID NO: 1873 - DNA, 504 bp, Homo sapiens
  chr1:217307502-217308006
  hyper
gagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaaga

SEQ ID NO: 1874 - DNA, 94 bp, Homo sapiens
  chr1:220101117-220101211
  hyper
tccaaaggatgcaaccgaaaggcacctgctacgtttgcgaacacggtcgcccccttctcccgcttcctttccaccgaggtcccccggagggtta

SEQ ID NO: 1875 - DNA, 239 bp, Homo sapiens
  chr1:220101370-220101609
  hyper
cgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtag

SEQ ID NO: 1876 - DNA, 110 bp, Homo sapiens; identical to SEQ ID NO: 118
  chr1:223936643-223936753
  hyper

SEQ ID NO: 1877 - DNA, 62 bp, Homo sapiens; identical to SEQ ID NO: 119
  chr1:223936995-223937057
  hyper

SEQ ID NO: 1878 - DNA, 62 bp, Homo sapiens; identical to SEQ ID NO: 120
  chr1:224804625-224804687
  hyper

SEQ ID NO: 1879 - DNA, 270 bp, Homo sapiens; identical to SEQ ID NO: 121
  chr1:224804846-224805116
  hyper

SEQ ID NO: 1880 - DNA, 555 bp, Homo sapiens; identical to SEQ ID NO: 122
  chr1:224805197-224805752
  hyper

SEQ ID NO: 1881 - DNA, 18 bp, Homo sapiens
  chr1:224805848-224805866
  hyper
cgccggtcctctcaaaga

SEQ ID NO: 1882 - DNA, 1554 bp, Homo sapiens; identical to SEQ ID NO: 124
  chr1:228194949-228196503
  hyper

SEQ ID NO: 1883 - DNA, 107 bp, Homo sapiens; identical to SEQ ID NO: 125
  chr1:228633813-228633920
  hyper

SEQ ID NO: 1884 - DNA, 29 bp, Homo sapiens
  chr1:228633921-228633950
  hyper
gcttctctgcagctgtacaccctgcactg

SEQ ID NO: 1885 - DNA, 157 bp, Homo sapiens; identical to SEQ ID NO: 127
  chr1:228633983-228634140
  hyper

SEQ ID NO: 1886 - DNA, 470 bp, Homo sapiens; identical to SEQ ID NO: 128
  chr1:228651432-228651902
  hyper

SEQ ID NO: 1887 - DNA, 247 bp, Homo sapiens; identical to SEQ ID NO: 129
  chr1:228652206-228652453
  hyper

SEQ ID NO: 1888 - DNA, 34 bp, Homo sapiens; identical to SEQ ID NO: 130
  chr1:228652508-228652542
  hyper

SEQ ID NO: 1889 - DNA, 140 bp, Homo sapiens; identical to SEQ ID NO: 131
  chr1:229542813-229542953
  hyper

SEQ ID NO: 1890 - DNA, 124 bp, Homo sapiens; identical to SEQ ID NO: 132
  chr1:229543220-229543344
  hyper

SEQ ID NO: 1891 - DNA, 86 bp, Homo sapiens; identical to SEQ ID NO: 133
  chr1:229567191-229567277
  hyper

SEQ ID NO: 1892 - DNA, 624 bp, Homo sapiens; identical to SEQ ID NO: 134
  chr1:229567369-229567993
  hyper

SEQ ID NO: 1893 - DNA, 193 bp, Homo sapiens; identical to SEQ ID NO: 135
  chr1:229568157-229568350
  hyper

SEQ ID NO: 1894 - DNA, 59 bp, Homo sapiens
  chr1:231297044-231297103
  hyper
gcggggaagaacagccgagcagaccaaacagccggggccgcgggtgggaggctgttccc

SEQ ID NO: 1895 - DNA, 29 bp, Homo sapiens
  chr1:231297104-231297133
  hyper
cagctcgtggctggcgttggagaatgtgg

SEQ ID NO: 1896 - DNA, 5 bp, Homo sapiens
  chr1:234040969-234040974
  hyper
aggct

SEQ ID NO: 1897 - DNA, 213 bp, Homo sapiens
  chr1:234041148-234041361
  hyper
cgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtgga

SEQ ID NO: 1898 - DNA, 55 bp, Homo sapiens
  chr1:234041415-234041470
  hyper
cgggccggtggggctcacgtccatcgaggagcggatcctgcgcatcactggctac

SEQ ID NO: 1899 - DNA, 130 bp, Homo sapiens
  chr1:235813667-235813797
  hyper
ggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 1900 - DNA, 26 bp, Homo sapiens
  chr1:235814009-235814035
  hyper
ggttctaggagcgactgctctccagg

SEQ ID NO: 1901 - DNA, 79 bp, Homo sapiens
  chr1:236227842-236227921
  hyper
ctgacctccctgcggcgatgcagcccacagccgccggggaggaagctccgcggggtccatgggtgccggggtcacggcc

SEQ ID NO: 1902 - DNA, 187 bp, Homo sapiens
  chr1:236228021-236228208
  hyper
cgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctc

SEQ ID NO: 1903 - DNA, 18 bp, Homo sapiens
  chr1:236228606-236228624
  hyper
acctcccgccttgggcgc

SEQ ID NO: 1904 - DNA, 50 bp, Homo sapiens
  chr1:236228705-236228755
  hyper
cgtggtcctctgattagggttgggtcgtggagagccggcgacgtggaaac

SEQ ID NO: 1905 - DNA, 49 bp, Homo sapiens; identical to SEQ ID NO: 136
  chr1:236849457-236849506
  hyper

SEQ ID NO: 1906 - DNA, 224 bp, Homo sapiens; identical to SEQ ID NO: 137
  chr1:237206511-237206735
  hyper

SEQ ID NO: 1907 - DNA, 626 bp, Homo sapiens; identical to SEQ ID NO: 138
  chr1:240254860-240255486
  hyper

SEQ ID NO: 1908 - DNA, 672 bp, Homo sapiens; identical to SEQ ID NO: 139
  chr1:240255487-240256159
  hyper

SEQ ID NO: 1909 - DNA, 117 bp, Homo sapiens
  chr1:240256663-240256780
  hyper
atcaagaccaccacccggcagctcagctcgcccaatcactccccgtctcagtcccctaatcagagccccaggatcaagaggcggccggaaccctccctgagccgagggtccagaact

SEQ ID NO: 1910 - DNA, 63 bp, Homo sapiens
  chr1:241587546-241587609
  hyper
tgccgcacttgcacacggagtgtggggggccaggcctgggaccaggagctggggccgggcttc

SEQ ID NO: 1911 - DNA, 268 bp, Homo sapiens
  chr1:241587610-241587878
  hyper
gcgcagaggcaggaagaggaagcggcacccgcttcggggacccagccggcggccaggccaccgcgcccacccggccgatggcaccgtgttcctgcgcctcgggagggaggaggctctgcgcgggactgcaggttctgccccgcatcggagtgatcgctgagcctgacgctctcgaaggctgggcctggggcccgcaatctactccggaggctttcccactgggcagggtcgctagcagggtgagagaaagccccgggccatccccgag

SEQ ID NO: 1912 - DNA, 530 bp, Homo sapiens
  chr1:242686734-242687264
  hyper
gaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctagg

SEQ ID NO: 1913 - DNA, 114 bp, Homo sapiens
  chr1:242687574-242687688
  hyper
ccatcctgacatgaccgggcggccgccggcgagcagcggactcgggacgggcgcgcggggagccgggcgcggagggcgagcgggaggcccagcgggagccggaggtggagctgg

SEQ ID NO: 1914 - DNA, 150 bp, Homo sapiens
  chr1:242688094-242688244
  hyper
ggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgc

SEQ ID NO: 1915 - DNA, 119 bp, Homo sapiens
  chr1:242688277-242688396
  hyper
cgcggggatggctccggagggagacactcaggaaaccacctccgcccttcccccatctctatccagcggcgccccctcaccctgcccccggctcgcttgggctgcgccttcccccattc

SEQ ID NO: 1916 - DNA, 116 bp, Homo sapiens; identical to SEQ ID NO: 140
  chr1:248020515-248020631
  hyper

SEQ ID NO: 1917 - DNA, 341 bp, Homo sapiens; identical to SEQ ID NO: 141
  chr1:248020956-248021297
  hyper

SEQ ID NO: 1918 - DNA, 127 bp, Homo sapiens
  chr2:288404-288531
  hyper
gcccacggaggaggccgggtgcggaccctcgcgctggccccggccgcgccacgtgctggaagcccctccacctcccggccatggcgccctcccgcacctgcccggcgccacccgggagccacctgcg

SEQ ID NO: 1919 - DNA, 249 bp, Homo sapiens; identical to SEQ ID NO: 142
  chr2:468423-468672
  hyper

SEQ ID NO: 1920 - DNA, 165 bp, Homo sapiens
  chr2:945845-946010
  hyper
cccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggcc

SEQ ID NO: 1921 - DNA, 207 bp, Homo sapiens
  chr2:946011-946218
  hyper
gctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgcca

SEQ ID NO: 1922 - DNA, 115 bp, Homo sapiens
  chr2:946289-946404
  hyper
ggcccctgccccgccagccccgctatggtcccccatccacccccgcgggagcgcccctgtccccccatcctgcacttcccccagagtcgcgcgccagtttcccgccccgtggaag

SEQ ID NO: 1923 - DNA, 466 bp, Homo sapiens
  chr2:1746567-1747033
  hyper
aggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatc

SEQ ID NO: 1924 - DNA, 259 bp, Homo sapiens
  chr2:5831789-5832048
  hyper
ggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagc

SEQ ID NO: 1925 - DNA, 116 bp, Homo sapiens
  chr2:5832731-5832847
  hyper
gcgaaagcggggtgccgaggactttgcaacttgcccaggaaggtggaggggtgggagggggagggggacctccgcacgagacccagcggcccgggttggagcgtccagccctgcag

SEQ ID NO: 1926 - DNA, 151 bp, Homo sapiens
  chr2:5833282-5833433
  hyper
ggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcg

SEQ ID NO: 1927 - DNA, 141 bp, Homo sapiens
  chr2:5833499-5833640
  hyper
cggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagc

SEQ ID NO: 1928 - DNA, 75 bp, Homo sapiens
  chr2:5833953-5834028
  hyper
gaatttctctcaaagcgcgcacagcgccagcgagcagcagctggggggcggcgcggcggccgggaacctgtccct

SEQ ID NO: 1929 - DNA, 87 bp, Homo sapiens
  chr2:5836085-5836172
  hyper
ggctcgggagctggccggggaggggcggatggaggggcctgggttgccagctcccttggtcggggtcctgctcgctggggcttgtgt

SEQ ID NO: 1930 - DNA, 104 bp, Homo sapiens
  chr2:5866074-5866178
  hyper
ctgggggcagcagagcgacgtgccagcgtccgtgttgggcgggtgtcggggggacccggacaccccgccctccttcctgcagagctctgcgggccctgtggcat

SEQ ID NO: 1931 - DNA, 133 bp, Homo sapiens
  chr2:20865714-20865847
  hyper
taaaggaaaaggacccgcctgcccttcttcggcagttcgtttggcccaggccttcgatcagctgaaagtttccgatctagggggatgtccaggctgccggcggagcagagccgataacccccctctcctgcgc

SEQ ID NO: 1932 - DNA, 232 bp, Homo sapiens
  chr2:20865848-20866080
  hyper
ttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttc

SEQ ID NO: 1933 - DNA, 676 bp, Homo sapiens
  chr2:25391058-25391734
  hyper
tcctagcaagctctcggagcctccggaccgccgcgagcccctgggggagaggaggccgccggctccctggagacagcgcctgcagcttcgcggccgtccgcccaggggccggacgtgggccctccagctcagctactggcggcttctcatgccgcagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaacttaattatggatggcgttgggtctccgcttagaacgggcgggaggctta

SEQ ID NO: 1934 - DNA, 37 bp, Homo sapiens; identical to SEQ ID NO: 143
  chr2:25438835-25438872
  hyper

SEQ ID NO: 1935 - DNA, 222 bp, Homo sapiens; identical to SEQ ID NO: 144
  chr2:25439138-25439360
  hyper

SEQ ID NO: 1936 - DNA, 179 bp, Homo sapiens; identical to SEQ ID NO: 145
  chr2:26407743-26407922
  hyper

SEQ ID NO: 1937 - DNA, 103 bp, Homo sapiens
  chr2:26522016-26522119
  hyper
aaaccagacctagaacgttgtatacggctgataggaccaggtccaccgctgcagcaggctgtgagaggggaaggcacgttcctggctaagcagcgtccaaaac

SEQ ID NO: 1938 - DNA, 806 bp, Homo sapiens
  chr2:27070324-27071130
  hyper
tctcagtggagagaacgcactccgggttcgagacctccccgggtgcagatgcgaactgcggtggccccaagtggccgtccactttgttcatgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtga

SEQ ID NO: 1939 - DNA, 170 bp, Homo sapiens
  chr2:29033528-29033698
  hyper
cggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagag

SEQ ID NO: 1940 - DNA, 590 bp, Homo sapiens
  chr2:29338158-29338748
  hyper
cgacaccccgcagacgctgtcagccggggtcgcggccccgcgtgcgcccgatcatctgactgctggggagtgcgggggcgcgggagccaggcgagccagcgcaggcgcgcgctgcctcctccgtccccaccgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtgggccgggggcgcgcggggcccccccgggccgcgggctggccggcggcggggttggggccggggtgggcggccctgggggcccgcggggaggtcagtggccccgggagggtcgcgcagaggcgctgggggctgtggaagccccgcggccgcctcccgtgggcaccggtgtcgctggccgcggggaggccttctcggggcggagcggcccacccgg

SEQ ID NO: 1941 - DNA, 281 bp, Homo sapiens
  chr2:29338809-29339090
  hyper
cggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcc

SEQ ID NO: 1942 - DNA, 279 bp, Homo sapiens; identical to SEQ ID NO: 146
  chr2:30453784-30454063
  hyper

SEQ ID NO: 1943 - DNA, 158 bp, Homo sapiens; identical to SEQ ID NO: 147
  chr2:38302718-38302876
  hyper

SEQ ID NO: 1944 - DNA, 38 bp, Homo sapiens; identical to SEQ ID NO: 148
  chr2:39187200-39187238
  hyper

SEQ ID NO: 1945 - DNA, 63 bp, Homo sapiens; identical to SEQ ID NO: 149
  chr2:39187544-39187607
  hyper

SEQ ID NO: 1946 - DNA, 392 bp, Homo sapiens; identical to SEQ ID NO: 150
  chr2:40678497-40678889
  hyper

SEQ ID NO: 1947 - DNA, 137 bp, Homo sapiens; identical to SEQ ID NO: 151
  chr2:40678949-40679086
  hyper

SEQ ID NO: 1948 - DNA, 432 bp, Homo sapiens; identical to SEQ ID NO: 152
  chr2:40679087-40679519
  hyper

SEQ ID NO: 1949 - DNA, 85 bp, Homo sapiens; identical to SEQ ID NO: 153
  chr2:40679520-40679605
  hyper

SEQ ID NO: 1950 - DNA, 177 bp, Homo sapiens
  chr2:42720270-42720447
  hyper
taggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgc

SEQ ID NO: 1951 - DNA, 119 bp, Homo sapiens; identical to SEQ ID NO: 154
  chr2:45028940-45029059
  hyper

SEQ ID NO: 1952 - DNA, 184 bp, Homo sapiens; identical to SEQ ID NO: 155
  chr2:45029183-45029367
  hyper

SEQ ID NO: 1953 - DNA, 86 bp, Homo sapiens; identical to SEQ ID NO: 156
  chr2:45155125-45155211
  hyper

SEQ ID NO: 1954 - DNA, 636 bp, Homo sapiens; identical to SEQ ID NO: 157
  chr2:45155355-45155991
  hyper

SEQ ID NO: 1955 - DNA, 820 bp, Homo sapiens; identical to SEQ ID NO: 158
  chr2:45155992-45156812
  hyper

SEQ ID NO: 1956 - DNA, 89 bp, Homo sapiens; identical to SEQ ID NO: 159
  chr2:45156832-45156921
  hyper

SEQ ID NO: 1957 - DNA, 96 bp, Homo sapiens; identical to SEQ ID NO: 160
  chr2:45157254-45157350
  hyper

SEQ ID NO: 1958 - DNA, 38 bp, Homo sapiens
  chr2:45160596-45160634
  hyper
tttgaaaagggagaacgtcagtccgatggtcggtggtt

SEQ ID NO: 1959 - DNA, 240 bp, Homo sapiens; identical to SEQ ID NO: 161
  chr2:45171324-45171564
  hyper

SEQ ID NO: 1960 - DNA, 43 bp, Homo sapiens; identical to SEQ ID NO: 162
  chr2:45171836-45171879
  hyper

SEQ ID NO: 1961 - DNA, 152 bp, Homo sapiens
  chr2:45181520-45181672
  hyper
aggactgagctaagacgccagaatgggttaaaggcatttccaaggaggaatggtgaggacttgatgaccagctgcagaccttataggctgccctccgaccttcagcttcctgtgcgctcacaattcacgtgctcacacgtgctccttagagg

SEQ ID NO: 1962 - DNA, 15 bp, Homo sapiens
  chr2:45240616-45240631
  hyper
cggtctgtcgggtcc

SEQ ID NO: 1963 - DNA, 406 bp, Homo sapiens
  chr2:45240763-45241169
  hyper
cgagcccgggcaaggttgagaggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctgcgacccccggccctgcgtccccgcccgcggtcc

SEQ ID NO: 1964 - DNA, 215 bp, Homo sapiens
  chr2:45241232-45241447
  hyper
cgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcc

SEQ ID NO: 1965 - DNA, 723 bp, Homo sapiens
  chr2:47796765-47797488
  hyper
cggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagcccc

SEQ ID NO: 1966 - DNA, 474 bp, Homo sapiens
  chr2:47797489-47797963
  hyper
gggccggggcggcgctcggggcccgggccacgacatccccccggcgggagcaggagcgtgaggatggtggccaggggtccggggccgccgcggagcccctcgccgccttcgcagagcccctcgtcgccttcccagagcccggacagaggggcgcctccgcctcctccccggcgctcaggccacacgcgagtcccgtggcccagcgggtgcccgggcaggggcgctcctctgcgcgccccgacgcctcgccggctcccgcggctccttacccgccgctctcgggcgcggggctccgcagctaggcccctgccgcccggtggccggcgtccgcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatc

SEQ ID NO: 1967 - DNA, 1069 bp, Homo sapiens
  chr2:47797964-47799033
  hyper
gcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtggagagttgggctgctgcgacgcctcccggtggctctggcggcaccaatgcggggcaccggagcaggtgtccgactgcggtgcgggctaccactccgccggggaacctcgtcttgctcctccctgcgcttcgcctctggaatctctcccttatctcatgccgcggtgaaactttgctcaagttggtggtgctctgaggtctccagggctggaggccgcgcgacgcgaatcgccgacactggattctcgggcgttagtccgaagtttaagttcccttcgttcactcctttgccctggatcgaaccgcagccccaggacgcagcgggttccactggaaacggggaatcggggagaggcggtcgctgggctccgggcgacctgggaacgagggcgtttgctccccctcccgaccgagcgggcggccggcgtcagcaccgcggacagcgcatcggtgccgcagccgcgggcgggcgccgctagggctgccaggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcggggaataacaccctgggtgcggtagagagtagaggaatagaggaggtgtaggggaagctcactggcagctcccctgaggccgg

SEQ ID NO: 1968 - DNA, 56 bp, Homo sapiens
  chr2:47799123-47799179
  hyper
cggctgcgggtgctcctctgctggacacaagccggctttgccggggccacaaaagt

SEQ ID NO: 1969 - DNA, 132 bp, Homo sapiens
  chr2:50573507-50573639
  hyper
ccttctggcaactgacgcccccttcccgcggggcccagccgcgcgaccagggctggtcctttagtaggtgtccacatctctctcccagtacctcgacaaggaacgcccctcccacccctcaccaccaacacc

SEQ ID NO: 1970 - DNA, 87 bp, Homo sapiens
  chr2:50573691-50573778
  hyper
cgcaccaagcacacccaaatgcacctcccttttgtcgagctcccatttctctgagccttaggagcccaggagcgagtgcagggtaga

SEQ ID NO: 1971 - DNA, 95 bp, Homo sapiens
  chr2:50574218-50574313
  hyper
atcctctccctccttcggacagtcttctcggggtcctggagtccgccgtgcctagcaccccaaacaatccgaaacatagccgaggcgaatgcagc

SEQ ID NO: 1972 - DNA, 54 bp, Homo sapiens; identical to SEQ ID NO: 163
  chr2:50574631-50574685
  hyper

SEQ ID NO: 1973 - DNA, 121 bp, Homo sapiens; identical to SEQ ID NO: 164
  chr2:50574738-50574859
  hyper

SEQ ID NO: 1974 - DNA, 147 bp, Homo sapiens; identical to SEQ ID NO: 165
  chr2:63275877-63276024
  hyper

SEQ ID NO: 1975 - DNA, 699 bp, Homo sapiens; identical to SEQ ID NO: 166
  chr2:63280952-63281651
  hyper

SEQ ID NO: 1976 - DNA, 493 bp, Homo sapiens; identical to SEQ ID NO: 167
  chr2:63285117-63285610
  hyper

SEQ ID NO: 1977 - DNA, 227 bp, Homo sapiens; identical to SEQ ID NO: 168
  chr2:63286358-63286585
  hyper

SEQ ID NO: 1978 - DNA, 55 bp, Homo sapiens; identical to SEQ ID NO: 169
  chr2:63286693-63286748
  hyper

SEQ ID NO: 1979 - DNA, 236 bp, Homo sapiens; identical to SEQ ID NO: 170
  chr2:63287082-63287318
  hyper

SEQ ID NO: 1980 - DNA, 58 bp, Homo sapiens; identical to SEQ ID NO: 171
  chr2:66808576-66808634
  hyper

SEQ ID NO: 1981 - DNA, 665 bp, Homo sapiens; identical to SEQ ID NO: 172
  chr2:66808726-66809391
  hyper

SEQ ID NO: 1982 - DNA, 268 bp, Homo sapiens; identical to SEQ ID NO: 173
  chr2:68546249-68546517
  hyper

SEQ ID NO: 1983 - DNA, 361 bp, Homo sapiens; identical to SEQ ID NO: 174
  chr2:68546552-68546913
  hyper

SEQ ID NO: 1984 - DNA, 856 bp, Homo sapiens
  chr2:71503452-71504308
  hyper
ggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagcggcagaacgcctggccgggccggcgttttccgggacactcgtttcggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtc

SEQ ID NO: 1985 - DNA, 139 bp, Homo sapiens; identical to SEQ ID NO: 175
  chr2:73147389-73147528
  hyper

SEQ ID NO: 1986 - DNA, 101 bp, Homo sapiens; identical to SEQ ID NO: 176
  chr2:73147966-73148067
  hyper

SEQ ID NO: 1987 - DNA, 19 bp, Homo sapiens
  chr2:73148174-73148193
  hyper
cgtccggccctgagcccct

SEQ ID NO: 1988 - DNA, 616 bp, Homo sapiens
  chr2:73151215-73151831
  hyper
agtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtc

SEQ ID NO: 1989 - DNA, 271 bp, Homo sapiens; identical to SEQ ID NO: 178
  chr2:73430485-73430756
  hyper

SEQ ID NO: 1990 - DNA, 731 bp, Homo sapiens; identical to SEQ ID NO: 179
  chr2:73518261-73518992
  hyper

SEQ ID NO: 1991 - DNA, 252 bp, Homo sapiens
  chr2:73519523-73519775
  hyper
ctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcac

SEQ ID NO: 1992 - DNA, 257 bp, Homo sapiens
  chr2:74740879-74741136
  hyper
ccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgcc

SEQ ID NO: 1993 - DNA, 339 bp, Homo sapiens
  chr2:74741137-74741476
  hyper
ttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttc

SEQ ID NO: 1994 - DNA, 70 bp, Homo sapiens
  chr2:74741775-74741845
  hyper
gggatgctgctgtttcggggaccccggcgccctgccttggccagccccgcgggcccctgaggccactctc

SEQ ID NO: 1995 - DNA, 83 bp, Homo sapiens
  chr2:74741872-74741955
  hyper
cgctgcctgaggcatcctccccaaccaccgaacctccggcggttctcctcggcccagaccgatggagccggggatgctgggtc

SEQ ID NO: 1996 - DNA, 324 bp, Homo sapiens; identical to SEQ ID NO: 180
  chr2:74742324-74742648
  hyper

SEQ ID NO: 1997 - DNA, 452 bp, Homo sapiens; identical to SEQ ID NO: 181
  chr2:74742693-74743145
  hyper

SEQ ID NO: 1998 - DNA, 6 bp, Homo sapiens
  chr2:74743766-74743772
  hyper
cgaagc

SEQ ID NO: 1999 - DNA, 270 bp, Homo sapiens
  chr2:80529985-80530255
  hyper
cgcccgcaatcccacaggttcccggccagggtgatgcttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgc

SEQ ID NO: 2000 - DNA, 66 bp, Homo sapiens
  chr2:80530256-80530322
  hyper
ggaagtgggcgaagttcaccttgaccaagtcgttgtgctcgaggtgcagctcggtgagcttaaaca

SEQ ID NO: 2001 - DNA, 52 bp, Homo sapiens
  chr2:85107454-85107506
  hyper
tggacacgcaaggctcggacagtggtcactccgcgaacgcactctgtgacct

SEQ ID NO: 2002 - DNA, 187 bp, Homo sapiens
  chr2:87016593-87016780
  hyper
ccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctg

SEQ ID NO: 2003 - DNA, 451 bp, Homo sapiens
  chr2:87017729-87018180
  hyper
tcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgt

SEQ ID NO: 2004 - DNA, 139 bp, Homo sapiens
  chr2:88751281-88751420
  hyper
ccatccgctcccacccgcagcctggacaagaagactcctggcagatcttccagccgcacaccgacccctgcgccggcccttgcgacccgcgtccgccctccccggctgggaagcacctgccagcggccctcacctgggt

SEQ ID NO: 2005 - DNA, 356 bp, Homo sapiens
  chr2:88751460-88751816
  hyper
cgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcgg

SEQ ID NO: 2006 - DNA, 498 bp, Homo sapiens
  chr2:88751942-88752440
  hyper
gtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagc

SEQ ID NO: 2007 - DNA, 69 bp, Homo sapiens; identical to SEQ ID NO: 183
  chr2:88752716-88752785
  hyper

SEQ ID NO: 2008 - DNA, 171 bp, Homo sapiens; identical to SEQ ID NO: 184
  chr2:89064805-89064976
  hyper

SEQ ID NO: 2009 - DNA, 350 bp, Homo sapiens; identical to SEQ ID NO: 185
  chr2:89065128-89065478
  hyper

SEQ ID NO: 2010 - DNA, 474 bp, Homo sapiens
  chr2:95691026-95691500
  hyper
ggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 2011 - DNA, 218 bp, Homo sapiens
  chr2:95691501-95691719
  hyper
ctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgct

SEQ ID NO: 2012 - DNA, 418 bp, Homo sapiens
  chr2:96990898-96991316
  hyper
gagagtgtgtggccacggcccctccactctcccagcaaacccacgggggcctcggtgcggacagagacccggtgtggggaggccgctgcccctgcacgctgggccacgggggtttgggcggggaggagcttgtactgggtgggcggggaggagcccggacggcgggagcggctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacggtgagtaacctgg

SEQ ID NO: 2013 - DNA, 15 bp, Homo sapiens
  chr2:97193049-97193064
  hyper
cggcagcagagcctg

SEQ ID NO: 2014 - DNA, 386 bp, Homo sapiens; identical to SEQ ID NO: 187
  chr2:97193251-97193637
  hyper

SEQ ID NO: 2015 - DNA, 71 bp, Homo sapiens; identical to SEQ ID NO: 188
  chr2:98963337-98963408
  hyper

SEQ ID NO: 2016 - DNA, 417 bp, Homo sapiens; identical to SEQ ID NO: 189
  chr2:98963409-98963826
  hyper

SEQ ID NO: 2017 - DNA, 325 bp, Homo sapiens; identical to SEQ ID NO: 190
  chr2:98963868-98964193
  hyper

SEQ ID NO: 2018 - DNA, 139 bp, Homo sapiens; identical to SEQ ID NO: 191
  chr2:99439368-99439507
  hyper

SEQ ID NO: 2019 - DNA, 178 bp, Homo sapiens; identical to SEQ ID NO: 192
  chr2:105458974-105459152
  hyper

SEQ ID NO: 2020 - DNA, 361 bp, Homo sapiens; identical to SEQ ID NO: 193
  chr2:105459902-105460263
  hyper

SEQ ID NO: 2021 - DNA, 247 bp, Homo sapiens; identical to SEQ ID NO: 194
  chr2:105460264-105460511
  hyper

SEQ ID NO: 2022 - DNA, 113 bp, Homo sapiens
  chr2:105461555-105461668
  hyper
cgcccgccgttgctcctctgttcccggtccctgtagtgcagtccccacccccaccgtccccagctcggggagggcggggacgcggcggtgcgaggggtcctgccctgctccgc

SEQ ID NO: 2023 - DNA, 84 bp, Homo sapiens
  chr2:105461699-105461783
  hyper
cgcgcaccgaatcagtgacaaaggcaagcgggcggcgccgagctccaagccggcgctcctacggcttggcgggaaggaggccca

SEQ ID NO: 2024 - DNA, 212 bp, Homo sapiens
  chr2:105469645-105469857
  hyper
tcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccgg

SEQ ID NO: 2025 - DNA, 681 bp, Homo sapiens
  chr2:105469880-105470561
  hyper
cggtggcggatttccaaggagcgtggccacgaccagagctcttggcgatgcgagcccccgcttcccacccccgccgatcagagaagggggccggctggtgaagggaagaggaaactttgaaaccactggggacacatctgtctataggtattagcttgaatggtacatccgtgccgcgcgctttacaaatctctggcggggcgggggtaagggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgagggggagggaggctggaggacgacagatttccagcttctacgacgctctgcctaaattaaaaagcaaccaatcggaacggccggaaggggggcctcgcgtcctgagccagtcattccgagcctgccaatcacccagcgggtagccaatcagcgggggccctggtgctcgacttccttgtatttgggaaagtgtggtggtgggtgcgcgctcgcggc

SEQ ID NO: 2026 - DNA, 246 bp, Homo sapiens
  chr2:105470562-105470808
  hyper
gagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagt

SEQ ID NO: 2027 - DNA, 292 bp, Homo sapiens
  chr2:105478762-105479054
  hyper
cagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggc

SEQ ID NO: 2028 - DNA, 47 bp, Homo sapiens
  chr2:105479055-105479102
  hyper
gccgggtccctgctcggcccggcacggccgggcggccagactgtggc

SEQ ID NO: 2029 - DNA, 111 bp, Homo sapiens
  chr2:107502619-107502730
  hyper
cactggagtccaaggcgtgcgtgtcacattttattccccggcagccgctcgggtgcgcgcgctacgcgctcccacactcacgctggcgcccgctagagctgggaccctggc

SEQ ID NO: 2030 - DNA, 43 bp, Homo sapiens
  chr2:107502865-107502908
  hyper
cggcctgcgggatcacctctccggggccagcgctgctccgcgc

SEQ ID NO: 2031 - DNA, 234 bp, Homo sapiens
  chr2:114256954-114257188
  hyper
acgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatgg

SEQ ID NO: 2032 - DNA, 184 bp, Homo sapiens
  chr2:114261280-114261464
  hyper
agcccaggcacccctcgactccccgggactccctgcgggcccgaagccgccttcccgaggcggcggagttgggcagctccgggccccgcgccgccccgcagagccggagtttctctccggagtctggatacagctctccgcttcgtcgccgcgcactggaccccggtagcgtggagcctgcccg

SEQ ID NO: 2033 - DNA, 683 bp, Homo sapiens; identical to SEQ ID NO: 195
  chr2:118981174-118981857
  hyper

SEQ ID NO: 2034 - DNA, 203 bp, Homo sapiens; identical to SEQ ID NO: 196
  chr2:118981945-118982148
  hyper

SEQ ID NO: 2035 - DNA, 244 bp, Homo sapiens; identical to SEQ ID NO: 197
  chr2:118982253-118982497
  hyper

SEQ ID NO: 2036 - DNA, 402 bp, Homo sapiens
  chr2:119067695-119068097
  hyper
cattaaaatgcaaatcgggcccgctgagaaaacaagtgacacaaaaagtgggcgccgcgcggccgccgcccgcgatggcgccgatggctgatgccgcgattacgccggcgggggcggcccgcgcgccacgaacgtgcccgacaagccgcgccgcttaatttctgaagagatttatattttttttgttgtcaggaaatgaacaaatacttatcaatgtaaaaactgctatctccgatctccccgccgggtttttcatactgatattctttgcaccccgtaacacaggaaatgaaaatcttctccgcctctcacgtcgccgctgcgccttcaaatcctctgcgagcagactggcctccccccaccggccccctcccgggctcccctccccggtaaacagaaaag

SEQ ID NO: 2037 - DNA, 141 bp, Homo sapiens
  chr2:119592997-119593138
  hyper
gtgactggagagcagcgggggacagcgtggcctcacccaaggtcagcgctggtccccacgtgtcggccgggggaggggaggggagcggacagtcggagcgttcggatgtccagttgagccgcggcgcggggcagccggggg

SEQ ID NO: 2038 - DNA, 81 bp, Homo sapiens
  chr2:119603030-119603111
  hyper
agaaaaacaggcctacggatgccagaagtctgctggatgtgcgggtgaaaaaaggaaagcgccgcgcggggaggatgcggg

SEQ ID NO: 2039 - DNA, 182 bp, Homo sapiens
  chr2:119607442-119607624
  hyper
ctgcaggagacgcctcgagaagggctgcggaagataatttataggttttaattactcttcattccgcctgatcagcttggcgttcatcacaggcctgtgaataaaaccctggtcaaaagctctgtcacatcgcgctggcaagacgcttaatcaaagtgagcggccccgcgcgccgcgcggcc

SEQ ID NO: 2040 - DNA, 7 bp, Homo sapiens
  chr2:119607847-119607854
  hyper
cgtcccc

SEQ ID NO: 2041 - DNA, 142 bp, Homo sapiens; identical to SEQ ID NO: 198
  chr2:119616141-119616283
  hyper

SEQ ID NO: 2042 - DNA, 2 bp, Homo sapiens
  chr2:119916524-119916526
  hyper
cg

SEQ ID NO: 2043 - DNA, 481 bp, Homo sapiens
  chr2:124782692-124783173
  hyper
cccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcg

SEQ ID NO: 2044 - DNA, 125 bp, Homo sapiens
  chr2:127783043-127783168
  hyper
actcccccagcaggacgtttactgaatctggagggagtcgccctgcagatatcccgcggaagccggaggagacccaggtgcgccccaccggctagctgcgcctgcgggtgcccaaattggtgtcc

SEQ ID NO: 2045 - DNA, 412 bp, Homo sapiens
  chr2:127783169-127783581
  hyper
ggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 2046 - DNA, 162 bp, Homo sapiens
  chr2:130737475-130737637
  hyper
tactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcat

SEQ ID NO: 2047 - DNA, 272 bp, Homo sapiens
  chr2:131720827-131721099
  hyper
caggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtc

SEQ ID NO: 2048 - DNA, 124 bp, Homo sapiens
  chr2:131721461-131721585
  hyper
ccccatgatgtcagccggcccgcacgcccctcgccctccgactgcgaccccggcccgggctcgcgcgccccgtcccccggcagccccgcggccgccgcaccgccgcccccggcccagccttccc

SEQ ID NO: 2049 - DNA, 83 bp, Homo sapiens
  chr2:131721866-131721949
  hyper
gggtctgtgctcttgggaccccccgcccccctcctgcctttccttctcctccctcactttctgcctgtcgtttccatctcctg

SEQ ID NO: 2050 - DNA, 295 bp, Homo sapiens
  chr2:131792225-131792520
  hyper
ccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggagg

SEQ ID NO: 2051 - DNA, 106 bp, Homo sapiens
  chr2:131792531-131792637
  hyper
cggcgccggcttcgcgggaggagccccaggcccgcgagcgcaggcgccccgcctctccccgggcgctgcgggccaccggctcggccctgtgcggcgggatctcggg

SEQ ID NO: 2052 - DNA, 184 bp, Homo sapiens
  chr2:132152311-132152495
  hyper
tgctgagccgaagctcggcggggctgagctccagctgggggcgggtagctgacagcctctaggcccgggctccctccagaggcagcgttgcaccctgaccctaacttccgcctgcggcgttcagatgcggaaagcagggagcctgaacccaaagctgcgatcagagaatcgtgtgtgtgaaggg

SEQ ID NO: 2053 - DNA, 325 bp, Homo sapiens; identical to SEQ ID NO: 199
  chr2:132182764-132183089
  hyper

SEQ ID NO: 2054 - DNA, 371 bp, Homo sapiens; identical to SEQ ID NO: 200
  chr2:139536937-139537308
  hyper

SEQ ID NO: 2055 - DNA, 200 bp, Homo sapiens
  chr2:144694315-144694515
  hyper
tggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccac

SEQ ID NO: 2056 - DNA, 704 bp, Homo sapiens
  chr2:144694553-144695257
  hyper
cgtggcgggtgcgtgccggtgtgtgtgcgtgacagcgcgcgcgtggcagggagttcgcgcgccagggtgcgcgtgccagcgcgggtgtgcgagggagtgcgcgcgggtgggagcgccaggggctggcggggcccgcgccctgggacgagcccctcgtgctccggctctgcgctcccgcagcgcccacgcagccgagaggagtgggtgatgacttcgtgacctcaacgtcctcccccgtccctcgacatgttcccgcgcctgaaaggtgcagaaaactccccccaccgctctggacgagactgagctaggcgtcgagggcgggcgccgccgcagaccggagctcgggctcgctggccgctcaggcgcagcggtgtggagggaacggacgcgcggcaaggcgacccgctctgggcaacgcgggcgcagctgccccgacgcaaggcactagctggtcgggggctcgggcgagccggggccggcgtgccggggcgtgcgctctctcggcaggcgagcgccgggctccgcggaggtccctgcgcccactgcctgcttctccgcccggcgacccggagtccccaggctgcggtgcgccaggccagacctgaccgagggcggaagacccgagcggcagggaggcagaaagaaaagaggtagcaagccccagacaagggatccttaattacagataaaaggcaaacaaaacc

SEQ ID NO: 2057 - DNA, 31 bp, Homo sapiens
  chr2:144695258-144695289
  hyper
tacaccacattttccacgtgtcagctgacgg

SEQ ID NO: 2058 - DNA, 463 bp, Homo sapiens; identical to SEQ ID NO: 201
  chr2:145273327-145273790
  hyper

SEQ ID NO: 2059 - DNA, 431 bp, Homo sapiens
  chr2:145274080-145274511
  hyper
actcagcctggataacgggctcctccagaccatgtagaaactgccgggaaaagtctcgctgcgccctgcgactccttcagtccccggcctgggggcagagcctgctggagaggagtcatccgtccccgagccatcatcgaccccaccggaccccgcgcggggccggccgactccctcccaccccggggtctgggcgcgatgggccgggccccgctgcccgcggaccgttacttggcgcaccgagaagcggccgggcgactccggcaagaaactttaagcctcgctgaggcgcagacccggttcccctctcctgccttcgcagtctctctgccacccccgcccccgccccgggatcctgcgcgatccagcgcctgggcccccgccctgccccaggcggacgctcccgaagcccggccggagacccggcgggc

SEQ ID NO: 2060 - DNA, 399 bp, Homo sapiens
  chr2:145274576-145274975
  hyper
cggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcccggaaaagtttggttcgggctgcttcttaccgtttttcctcctgggattggcttgtttgcgcctcttgcaccgggggccatccgccatgatcggctgcttcattgataagagcggatcagatggcagttcgcatggactcggcgccctgcttcggcagcac

SEQ ID NO: 2061 - DNA, 479 bp, Homo sapiens
  chr2:145274976-145275455
  hyper
caggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctgg

SEQ ID NO: 2062 - DNA, 92 bp, Homo sapiens
  chr2:145281307-145281399
  hyper
ggaggaggtggggggcggcaggggtccaagccaagccaaacggttttctcacgtgcagactcgcaatccaatccattcggagttgagcctag

SEQ ID NO: 2063 - DNA, 746 bp, Homo sapiens
  chr2:149633311-149634057
  hyper
ggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagagg

SEQ ID NO: 2064 - DNA, 24 bp, Homo sapiens
  chr2:149645535-149645559
  hyper
ccgcagcaagggctgcgaccccgc

SEQ ID NO: 2065 - DNA, 287 bp, Homo sapiens; identical to SEQ ID NO: 203
  chr2:149645560-149645847
  hyper

SEQ ID NO: 2066 - DNA, 247 bp, Homo sapiens
  chr2:154334199-154334446
  hyper
caaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggc

SEQ ID NO: 2067 - DNA, 266 bp, Homo sapiens
  chr2:154335184-154335450
  hyper
gtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgc

SEQ ID NO: 2068 - DNA, 1265 bp, Homo sapiens; identical to SEQ ID NO: 204
  chr2:157176900-157178165
  hyper

SEQ ID NO: 2069 - DNA, 13 bp, Homo sapiens
  chr2:157178166-157178179
  hyper
aggcccaggcagg

SEQ ID NO: 2070 - DNA, 55 bp, Homo sapiens; identical to SEQ ID NO: 206
  chr2:162275172-162275227
  hyper

SEQ ID NO: 2071 - DNA, 128 bp, Homo sapiens; identical to SEQ ID NO: 207
  chr2:162275310-162275438
  hyper

SEQ ID NO: 2072 - DNA, 128 bp, Homo sapiens; identical to SEQ ID NO: 208
  chr2:162275472-162275600
  hyper

SEQ ID NO: 2073 - DNA, 264 bp, Homo sapiens; identical to SEQ ID NO: 209
  chr2:162280152-162280416
  hyper

SEQ ID NO: 2074 - DNA, 216 bp, Homo sapiens; identical to SEQ ID NO: 210
  chr2:162280740-162280956
  hyper

SEQ ID NO: 2075 - DNA, 238 bp, Homo sapiens; identical to SEQ ID NO: 211
  chr2:162283365-162283603
  hyper

SEQ ID NO: 2076 - DNA, 273 bp, Homo sapiens; identical to SEQ ID NO: 212
  chr2:162283782-162284055
  hyper

SEQ ID NO: 2077 - DNA, 228 bp, Homo sapiens
  chr2:168150566-168150794
  hyper
ctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggc

SEQ ID NO: 2078 - DNA, 22 bp, Homo sapiens
  chr2:171675361-171675383
  hyper
tgactcccagggcaccggaaag

SEQ ID NO: 2079 - DNA, 131 bp, Homo sapiens; identical to SEQ ID NO: 214
  chr2:171675522-171675653
  hyper

SEQ ID NO: 2080 - DNA, 329 bp, Homo sapiens; identical to SEQ ID NO: 215
  chr2:172945896-172946225
  hyper

SEQ ID NO: 2081 - DNA, 56 bp, Homo sapiens
  chr2:172949227-172949283
  hyper
ctaaactctggaagtcgcgctagacctcaggaggccggaaaatgaccacctggcgt

SEQ ID NO: 2082 - DNA, 499 bp, Homo sapiens
  chr2:172949348-172949847
  hyper
cgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtc

SEQ ID NO: 2083 - DNA, 323 bp, Homo sapiens; identical to SEQ ID NO: 216
  chr2:172955471-172955794
  hyper

SEQ ID NO: 2084 - DNA, 59 bp, Homo sapiens; identical to SEQ ID NO: 217
  chr2:172957976-172958035
  hyper

SEQ ID NO: 2085 - DNA, 94 bp, Homo sapiens; identical to SEQ ID NO: 218
  chr2:172964795-172964889
  hyper

SEQ ID NO: 2086 - DNA, 4 bp, Homo sapiens
  chr2:172965295-172965299
  hyper
gggg

SEQ ID NO: 2087 - DNA, 116 bp, Homo sapiens; identical to SEQ ID NO: 220
  chr2:172965647-172965763
  hyper

SEQ ID NO: 2088 - DNA, 802 bp, Homo sapiens; identical to SEQ ID NO: 221
  chr2:172966250-172967052
  hyper

SEQ ID NO: 2089 - DNA, 1168 bp, Homo sapiens; identical to SEQ ID NO: 222
  chr2:175190805-175191973
  hyper

SEQ ID NO: 2090 - DNA, 149 bp, Homo sapiens; identical to SEQ ID NO: 223
  chr2:175192084-175192233
  hyper

SEQ ID NO: 2091 - DNA, 83 bp, Homo sapiens; identical to SEQ ID NO: 224
  chr2:175193294-175193377
  hyper

SEQ ID NO: 2092 - DNA, 267 bp, Homo sapiens; identical to SEQ ID NO: 225
  chr2:175193378-175193645
  hyper

SEQ ID NO: 2093 - DNA, 35 bp, Homo sapiens; identical to SEQ ID NO: 226
  chr2:175193808-175193843
  hyper

SEQ ID NO: 2094 - DNA, 90 bp, Homo sapiens; identical to SEQ ID NO: 227
  chr2:175199465-175199555
  hyper

SEQ ID NO: 2095 - DNA, 8 bp, Homo sapiens
  chr2:175199921-175199929
  hyper
ggagaaac

SEQ ID NO: 2096 - DNA, 181 bp, Homo sapiens; identical to SEQ ID NO: 229
  chr2:175200260-175200441
  hyper

SEQ ID NO: 2097 - DNA, 144 bp, Homo sapiens; identical to SEQ ID NO: 230
  chr2:175200709-175200853
  hyper

SEQ ID NO: 2098 - DNA, 267 bp, Homo sapiens; identical to SEQ ID NO: 231
  chr2:175200916-175201183
  hyper

SEQ ID NO: 2099 - DNA, 183 bp, Homo sapiens; identical to SEQ ID NO: 232
  chr2:175201359-175201542
  hyper

SEQ ID NO: 2100 - DNA, 54 bp, Homo sapiens; identical to SEQ ID NO: 233
  chr2:175201775-175201829
  hyper

SEQ ID NO: 2101 - DNA, 120 bp, Homo sapiens; identical to SEQ ID NO: 234
  chr2:175202126-175202246
  hyper

SEQ ID NO: 2102 - DNA, 33 bp, Homo sapiens; identical to SEQ ID NO: 235
  chr2:175202568-175202601
  hyper

SEQ ID NO: 2103 - DNA, 78 bp, Homo sapiens; identical to SEQ ID NO: 236
  chr2:175202633-175202711
  hyper

SEQ ID NO: 2104 - DNA, 119 bp, Homo sapiens; identical to SEQ ID NO: 237
  chr2:175204828-175204947
  hyper

SEQ ID NO: 2105 - DNA, 558 bp, Homo sapiens; identical to SEQ ID NO: 238
  chr2:175208311-175208869
  hyper

SEQ ID NO: 2106 - DNA, 93 bp, Homo sapiens; identical to SEQ ID NO: 239
  chr2:175208996-175209089
  hyper

SEQ ID NO: 2107 - DNA, 148 bp, Homo sapiens
  chr2:176940167-176940315
  hyper
aattgcagagggtagcgattgtttcatcaaatgtttcatatttctgagtttggagggcggggatgccagggtaagcttcctccgagcgactaaggagcagcaacaagctctggaatttcctctcggggtggtccgttccaccttaaat

SEQ ID NO: 2108 - DNA, 59 bp, Homo sapiens; identical to SEQ ID NO: 240
  chr2:176944346-176944405
  hyper

SEQ ID NO: 2109 - DNA, 391 bp, Homo sapiens; identical to SEQ ID NO: 241
  chr2:176944456-176944847
  hyper

SEQ ID NO: 2110 - DNA, 132 bp, Homo sapiens; identical to SEQ ID NO: 242
  chr2:176945137-176945269
  hyper

SEQ ID NO: 2111 - DNA, 203 bp, Homo sapiens; identical to SEQ ID NO: 243
  chr2:176945581-176945784
  hyper

SEQ ID NO: 2112 - DNA, 43 bp, Homo sapiens
  chr2:176949959-176950002
  hyper
ccagccccttacctgcggccacaggtattcccagcgttgggtc

SEQ ID NO: 2113 - DNA, 184 bp, Homo sapiens
  chr2:176950074-176950258
  hyper
cgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggagg

SEQ ID NO: 2114 - DNA, 68 bp, Homo sapiens; identical to SEQ ID NO: 244
  chr2:176957347-176957415
  hyper

SEQ ID NO: 2115 - DNA, 53 bp, Homo sapiens; identical to SEQ ID NO: 245
  chr2:176957576-176957629
  hyper

SEQ ID NO: 2116 - DNA, 207 bp, Homo sapiens; identical to SEQ ID NO: 246
  chr2:176957914-176958121
  hyper

SEQ ID NO: 2117 - DNA, 52 bp, Homo sapiens
  chr2:176958391-176958443
  hyper
ctttccaggtaggggcgatggagaaaagggaccgacacgagggagggggaga

SEQ ID NO: 2118 - DNA, 298 bp, Homo sapiens; identical to SEQ ID NO: 247
  chr2:176959213-176959511
  hyper

SEQ ID NO: 2119 - DNA, 213 bp, Homo sapiens
  chr2:176964389-176964602
  hyper
cggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttct

SEQ ID NO: 2120 - DNA, 35 bp, Homo sapiens
  chr2:176969579-176969614
  hyper
tggctcaccctcccccgccaaatcgctgctcccgc

SEQ ID NO: 2121 - DNA, 69 bp, Homo sapiens
  chr2:176969676-176969745
  hyper
cggtcagcaggctccatactgggggcgccgggctgcctgcaccccaccccgtgccgccagtagagagaa

SEQ ID NO: 2122 - DNA, 105 bp, Homo sapiens
  chr2:176976065-176976170
  hyper
ccacccaaggcaagccgaacccgagataccattttccgtttgcaggggcctggagatccacacgagggcgcgctcacgttccagaagccgcgtttgaccaagagg

SEQ ID NO: 2123 - DNA, 168 bp, Homo sapiens; identical to SEQ ID NO: 248
  chr2:176980770-176980938
  hyper

SEQ ID NO: 2124 - DNA, 130 bp, Homo sapiens; identical to SEQ ID NO: 249
  chr2:176981376-176981506
  hyper

SEQ ID NO: 2125 - DNA, 504 bp, Homo sapiens
  chr2:176986711-176987215
  hyper
cgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctgg

SEQ ID NO: 2126 - DNA, 277 bp, Homo sapiens
  chr2:176993514-176993791
  hyper
atttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttac

SEQ ID NO: 2127 - DNA, 256 bp, Homo sapiens
  chr2:176994124-176994380
  hyper
tccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggc

SEQ ID NO: 2128 - DNA, 63 bp, Homo sapiens
  chr2:176994497-176994560
  hyper
cgccggtgcgcaccgggtcggcagcctcggcggcgggggcgagattggcgggaggggggcgcg

SEQ ID NO: 2129 - DNA, 57 bp, Homo sapiens; identical to SEQ ID NO: 250
  chr2:177001206-177001263
  hyper

SEQ ID NO: 2130 - DNA, 432 bp, Homo sapiens; identical to SEQ ID NO: 251
  chr2:177001264-177001696
  hyper

SEQ ID NO: 2131 - DNA, 75 bp, Homo sapiens; identical to SEQ ID NO: 252
  chr2:177001781-177001856
  hyper

SEQ ID NO: 2132 - DNA, 73 bp, Homo sapiens
  chr2:177042926-177042999
  hyper
ggcggggtgggctggcgctcctgatccacctggaacacttttgcaaagacagacggtgagttaatcaccctac

SEQ ID NO: 2133 - DNA, 19 bp, Homo sapiens
  chr2:177053935-177053954
  hyper
cctcggccgtcttctcggg

SEQ ID NO: 2134 - DNA, 364 bp, Homo sapiens; identical to SEQ ID NO: 254
  chr2:177053999-177054363
  hyper

SEQ ID NO: 2135 - DNA, 158 bp, Homo sapiens; identical to SEQ ID NO: 255
  chr2:182321397-182321555
  hyper

SEQ ID NO: 2136 - DNA, 27 bp, Homo sapiens
  chr2:182321811-182321838
  hyper
ctggcatttgggccacgccgggctggg

SEQ ID NO: 2137 - DNA, 154 bp, Homo sapiens; identical to SEQ ID NO: 257
  chr2:182322038-182322192
  hyper

SEQ ID NO: 2138 - DNA, 631 bp, Homo sapiens; identical to SEQ ID NO: 258
  chr2:182322399-182323030
  hyper

SEQ ID NO: 2139 - DNA, 440 bp, Homo sapiens
  chr2:182542878-182543318
  hyper
agctgtccatggtaccgtaaggcggactgggcagcccaggcgactggtaggagtaggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 2140 - DNA, 397 bp, Homo sapiens
  chr2:182545388-182545785
  hyper
ccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacaga

SEQ ID NO: 2141 - DNA, 84 bp, Homo sapiens
  chr2:182546001-182546085
  hyper
cgccatataaaagcggcttcatctgtaaacgcagcgttgagattagttccccaacctccctaaccggatcgtcctctcccagtt

SEQ ID NO: 2142 - DNA, 495 bp, Homo sapiens; identical to SEQ ID NO: 259
  chr2:182547437-182547932
  hyper

SEQ ID NO: 2143 - DNA, 100 bp, Homo sapiens; identical to SEQ ID NO: 260
  chr2:182548061-182548161
  hyper

SEQ ID NO: 2144 - DNA, 366 bp, Homo sapiens
  chr2:182549088-182549454
  hyper
ggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggcc

SEQ ID NO: 2145 - DNA, 110 bp, Homo sapiens
  chr2:183731222-183731332
  hyper
ccagggcaagcagcccggcccgcagcagcagcatccctcccgggctgccgcagaccatgatcccggcaggatggggcagggtgcagccgcgcagtggacgccaaaaggcc

SEQ ID NO: 2146 - DNA, 640 bp, Homo sapiens
  chr2:183731466-183732106
  hyper
cgcccctgccgcccaggctgctctttcccaacgtctaagccttcggaagcagcaacatctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtgggctaagagctgcggccgccgctgcggctgcgaccctggctggcaggagggacgctcaggaggagccccgcagggacgtctgtgcctctgcccgggcggctctgcactttcctacctcccgcctgagagggagctccgcccctggggcagtctctgccctccagtgccggctgctcttcccgagaatggagtgggcgcccggggaagagaaggcctgggagtcgcaggcggtggggtgcgaagccgtgcgagtgcgagaccccaagacagcgccgagtcgagcgcgccctcacactagg

SEQ ID NO: 2147 - DNA, 500 bp, Homo sapiens
  chr2:185463255-185463755
  hyper
aactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaaggga

SEQ ID NO: 2148 - DNA, 293 bp, Homo sapiens
  chr2:193059025-193059318
  hyper
acgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcag

SEQ ID NO: 2149 - DNA, 165 bp, Homo sapiens
  chr2:193059344-193059509
  hyper
cggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgcc

SEQ ID NO: 2150 - DNA, 707 bp, Homo sapiens
  chr2:193059734-193060441
  hyper
gcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatcc

SEQ ID NO: 2151 - DNA, 271 bp, Homo sapiens
  chr2:193060675-193060946
  hyper
tactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 2152 - DNA, 29 bp, Homo sapiens
  chr2:200327423-200327452
  hyper
ggaggtagagactgtggaggtcctcctcc

SEQ ID NO: 2153 - DNA, 365 bp, Homo sapiens
  chr2:200329029-200329394
  hyper
ggagccacatccggacttgggaaccccgtgtcgggcttagaggacttcactgggcgggttggggtttattttcaataaattcagctgttcacatacacccccaccaccatttccacgcgcgcgcgcgcacacacacacacacacacacagagggacttgtcaactattgagacagcgacccagaaaggtgtaaattcacctggtgcccacccaattgcaaagctcccagacccacacaaaacactagcgagccctggaggtctgagacgccccgcgcccgactcacggcgcgaacaccagcgctccggccgggtcgcaggggccggtgcccagcgggccggggtctggcgagccaggcagcgggc

SEQ ID NO: 2154 - DNA, 262 bp, Homo sapiens
  chr2:200329432-200329694
  hyper
cgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctgggg

SEQ ID NO: 2155 - DNA, 49 bp, Homo sapiens
  chr2:200335076-200335125
  hyper
tgccaacttggggcacggaggcgacgggctgctccgaagctggagggtt

SEQ ID NO: 2156 - DNA, 217 bp, Homo sapiens
  chr2:201450490-201450707
  hyper
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggtt

SEQ ID NO: 2157 - DNA, 40 bp, Homo sapiens
  chr2:207139115-207139155
  hyper
atttggaccctcaaacgctaaaaccttggtctctacttcg

SEQ ID NO: 2158 - DNA, 606 bp, Homo sapiens
  chr2:207139217-207139823
  hyper
cggagtggggccctgaccagggaggaagtgtccgctttaagagcttctggaggggaggaaggggctcctccgcccgggtgggagagtgagtgagtgggtgggcgggcagggggcggtcccgccgctcctgcgtcagaaggggtctggttttcgcaccttccctgacgtcaaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccacc

SEQ ID NO: 2159 - DNA, 310 bp, Homo sapiens
  chr2:207506759-207507069
  hyper
acacccctttattctcggacgaggcccgtgtggtgagcgggaacccctgctgtcccctggaccagcgcggagctgggccctaactttgcagttcccgccgcatcggcacgcacccgcgaggtgggagcgggaagcccagccgcattagaggctcaattccggcaggtgcagagtgggtgcgggtcaaggccaatgagagtgtgtgtggccaagcccgctggtttcctgaaccgaaattctccggggagggagagaagaggagggtgcgggagacggacttggaggcgagaggtggcggcagtttccagga

SEQ ID NO: 2160 - DNA, 695 bp, Homo sapiens
  chr2:213402687-213403382
  hyper
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtgggggtgcgaggggggcgggcgcggcgcgcg

SEQ ID NO: 2161 - DNA, 93 bp, Homo sapiens
  chr2:218806209-218806302
  hyper
gccagggcagagcgtcgggctcttggttccttacacattggcaggaaggagggggcccctgcgagtggtctgcgcccacgccccaggccagag

SEQ ID NO: 2162 - DNA, 394 bp, Homo sapiens; identical to SEQ ID NO: 262
  chr2:219736151-219736545
  hyper

SEQ ID NO: 2163 - DNA, 231 bp, Homo sapiens
  chr2:220174065-220174296
  hyper
ccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctaccta

SEQ ID NO: 2164 - DNA, 280 bp, Homo sapiens
  chr2:220196354-220196634
  hyper
gaagggaaagagcttcgggaaggggagctgattctctgaggcagcgttcccaggactggtgggaaggagtggtgacccgctcgggctcggcgtggacccggagcgcgcctggcgctgtccgtggtgctgagaggtggggaggccagcgtggcggcggcgctgggcggaatgtgggcgagacatctccgcaaggcttggcggtccttccccacggccctcatcctctcattgccaccaggcctcctcccacagctgttcctgaatccgctgcattggcctc

SEQ ID NO: 2165 - DNA, 102 bp, Homo sapiens; identical to SEQ ID NO: 263
  chr2:220299533-220299635
  hyper

SEQ ID NO: 2166 - DNA, 174 bp, Homo sapiens; identical to SEQ ID NO: 264
  chr2:220299885-220300059
  hyper

SEQ ID NO: 2167 - DNA, 618 bp, Homo sapiens; identical to SEQ ID NO: 265
  chr2:220349101-220349719
  hyper

SEQ ID NO: 2168 - DNA, 1308 bp, Homo sapiens
  chr2:220416379-220417687
  hyper
ctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaagg

SEQ ID NO: 2169 - DNA, 749 bp, Homo sapiens; identical to SEQ ID NO: 266
  chr2:223158730-223159479
  hyper

SEQ ID NO: 2170 - DNA, 145 bp, Homo sapiens; identical to SEQ ID NO: 267
  chr2:223161540-223161685
  hyper

SEQ ID NO: 2171 - DNA, 220 bp, Homo sapiens; identical to SEQ ID NO: 268
  chr2:223161806-223162026
  hyper

SEQ ID NO: 2172 - DNA, 32 bp, Homo sapiens; identical to SEQ ID NO: 269
  chr2:223162859-223162891
  hyper

SEQ ID NO: 2173 - DNA, 297 bp, Homo sapiens; identical to SEQ ID NO: 270
  chr2:223162928-223163225
  hyper

SEQ ID NO: 2174 - DNA, 337 bp, Homo sapiens; identical to SEQ ID NO: 271
  chr2:223163472-223163809
  hyper

SEQ ID NO: 2175 - DNA, 193 bp, Homo sapiens; identical to SEQ ID NO: 272
  chr2:223163810-223164003
  hyper

SEQ ID NO: 2176 - DNA, 300 bp, Homo sapiens
  chr2:223167250-223167550
  hyper
aagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgg

SEQ ID NO: 2177 - DNA, 416 bp, Homo sapiens; identical to SEQ ID NO: 273
  chr2:223176096-223176512
  hyper

SEQ ID NO: 2178 - DNA, 307 bp, Homo sapiens; identical to SEQ ID NO: 274
  chr2:223176719-223177026
  hyper

SEQ ID NO: 2179 - DNA, 232 bp, Homo sapiens
  chr2:230578195-230578427
  hyper
gggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttaca

SEQ ID NO: 2180 - DNA, 352 bp, Homo sapiens
  chr2:232791677-232792029
  hyper
gactggggtgggaggcgcagggagagcggggttcgcctgggccgcaggggggagcgcaagtcttccacactggagagtgcaggggtgtcgccagcctgagtgtttgagcgcaaggcgggaacgaggggactgcgagcgcggaaccaagatattcatgctcatgcgtgtgctccgcggcatcgtatgctcgccagttactgctctaggttcacgttcagccggtttcggccacacagaacgtcccggggtctgactccgctggtgaactccctctgtgggaacaatgcgcacctgaccttgcctgcacccacgcgaggatccgctgctgggggaagcccgctccagtatcctg

SEQ ID NO: 2181 - DNA, 277 bp, Homo sapiens; identical to SEQ ID NO: 275
  chr2:233350263-233350540
  hyper

SEQ ID NO: 2182 - DNA, 436 bp, Homo sapiens; identical to SEQ ID NO: 276
  chr2:233350843-233351279
  hyper

SEQ ID NO: 2183 - DNA, 181 bp, Homo sapiens; identical to SEQ ID NO: 277
  chr2:233351415-233351596
  hyper

SEQ ID NO: 2184 - DNA, 351 bp, Homo sapiens; identical to SEQ ID NO: 278
  chr2:233352101-233352452
  hyper

SEQ ID NO: 2185 - DNA, 257 bp, Homo sapiens; identical to SEQ ID NO: 279
  chr2:233352506-233352763
  hyper

SEQ ID NO: 2186 - DNA, 136 bp, Homo sapiens; identical to SEQ ID NO: 280
  chr2:233352775-233352911
  hyper

SEQ ID NO: 2187 - DNA, 357 bp, Homo sapiens; identical to SEQ ID NO: 281
  chr2:237072641-237072998
  hyper

SEQ ID NO: 2188 - DNA, 16 bp, Homo sapiens
  chr2:237072999-237073015
  hyper
ctcacactcgctggcc

SEQ ID NO: 2189 - DNA, 440 bp, Homo sapiens; identical to SEQ ID NO: 283
  chr2:237073056-237073496
  hyper

SEQ ID NO: 2190 - DNA, 9 bp, Homo sapiens
  chr2:237073564-237073573
  hyper
cgcttgcct

SEQ ID NO: 2191 - DNA, 377 bp, Homo sapiens; identical to SEQ ID NO: 285
  chr2:237082343-237082720
  hyper

SEQ ID NO: 2192 - DNA, 202 bp, Homo sapiens
  chr2:237416164-237416366
  hyper
tcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgct

SEQ ID NO: 2193 - DNA, 43 bp, Homo sapiens
  chr2:238864588-238864631
  hyper
ccaccatccaaagggcgacagggaggcgtccccccaaccccgg

SEQ ID NO: 2194 - DNA, 330 bp, Homo sapiens
  chr2:238864726-238865056
  hyper
cgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactca

SEQ ID NO: 2195 - DNA, 111 bp, Homo sapiens
  chr2:239140138-239140249
  hyper
cgggggctgcagagccttcatctcttcctccgtcccgggatgtcggagagacggcagcccagcctccgccaccgcaaagctgcttaacgggcagcgcgagtccctcgggca

SEQ ID NO: 2196 - DNA, 187 bp, Homo sapiens; identical to SEQ ID NO: 286
  chr2:241393223-241393410
  hyper

SEQ ID NO: 2197 - DNA, 301 bp, Homo sapiens
  chr2:241758377-241758678
  hyper
ccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttcctt

SEQ ID NO: 2198 - DNA, 522 bp, Homo sapiens; identical to SEQ ID NO: 287
  chr3:239347-239869
  hyper

SEQ ID NO: 2199 - DNA, 81 bp, Homo sapiens
  chr3:3840498-3840579
  hyper
tcaaagtttcagaaacgttttcggaaagcctcctccaatgggaagcgacttcgccgctgagttaagcgtccgaatcctcct

SEQ ID NO: 2200 - DNA, 47 bp, Homo sapiens
  chr3:9595395-9595442
  hyper
gggactggcacggcctaggcgccgcggctcggcgctcccagcagcgg

SEQ ID NO: 2201 - DNA, 334 bp, Homo sapiens
  chr3:9904291-9904625
  hyper
gatccatgggaagatcgggtggctcaggggagtgactccccggcttggtcggcgctttgaggccccggggacccagcggagagggctcgggtgaggcatctggaggcgctgaatggggccgggagccgcgggacccgcagagggcgcctgtccgtgtgggcgcagcagcgcctagagggaggcggccccggcagcccgcaggggtcaggctctgctggagcaggggcgtccctgtctccgcttcccagcgcaggctgggtggggccgatggccattaaagccccgccccccgcggctcaccgccgcctggccccgtccccgaggccagaaaaga

SEQ ID NO: 2202 - DNA, 182 bp, Homo sapiens; identical to SEQ ID NO: 288
  chr3:11035171-11035353
  hyper

SEQ ID NO: 2203 - DNA, 6 bp, Homo sapiens
  chr3:11035382-11035388
  hyper
cgggca

SEQ ID NO: 2204 - DNA, 535 bp, Homo sapiens
  chr3:13323494-13324029
  hyper
aggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctggg

SEQ ID NO: 2205 - DNA, 114 bp, Homo sapiens
  chr3:13324234-13324348
  hyper
gggatggcgccgagcggctgcgggccggggccggggcccgggtcggggcggcgggcgcacgcggccaggtgtcgccggtgtcgctccagcaggccggcgttctcccggctcagc

SEQ ID NO: 2206 - DNA, 19 bp, Homo sapiens
  chr3:13324419-13324438
  hyper
gatccgggtcagctcctgc

SEQ ID NO: 2207 - DNA, 194 bp, Homo sapiens; identical to SEQ ID NO: 290
  chr3:13590447-13590641
  hyper

SEQ ID NO: 2208 - DNA, 48 bp, Homo sapiens; identical to SEQ ID NO: 291
  chr3:13590973-13591021
  hyper

SEQ ID NO: 2209 - DNA, 119 bp, Homo sapiens
  chr3:16554347-16554466
  hyper
ttctggtggttccggcgcttcctcggagcgcgcggcatgtctgctcctacacgtccagcacctctgtccccagagcaaacccacctcccagggcacacgcagaggggcagtcaggcacc

SEQ ID NO: 2210 - DNA, 189 bp, Homo sapiens
  chr3:16554467-16554656
  hyper
cctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggc

SEQ ID NO: 2211 - DNA, 45 bp, Homo sapiens
  chr3:26665077-26665122
  hyper
tgtgttcttgccagtcgacttttcactccccgcagctctggctcc

SEQ ID NO: 2212 - DNA, 181 bp, Homo sapiens
  chr3:27765181-27765362
  hyper
agctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttc

SEQ ID NO: 2213 - DNA, 367 bp, Homo sapiens
  chr3:28616764-28617131
  hyper
ctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttct

SEQ ID NO: 2214 - DNA, 306 bp, Homo sapiens
  chr3:28617343-28617649
  hyper
ggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaa

SEQ ID NO: 2215 - DNA, 606 bp, Homo sapiens; identical to SEQ ID NO: 292
  chr3:32858353-32858959
  hyper

SEQ ID NO: 2216 - DNA, 30 bp, Homo sapiens; identical to SEQ ID NO: 293
  chr3:32859255-32859285
  hyper

SEQ ID NO: 2217 - DNA, 800 bp, Homo sapiens; identical to SEQ ID NO: 294
  chr3:32859417-32860217
  hyper

SEQ ID NO: 2218 - DNA, 770 bp, Homo sapiens
  chr3:33260026-33260796
  hyper
gctgggtcgcaggaccgcggctcgttcgttcctctcaggcttgcgcttgccgcttgccgggccggtcagagggagcagccccggcgagctacgccctccctgcccggaccccacgctccaccccccgccccgccgcctcccgcacactcaccatccgcccgcaccgaaaggcgcggcagaccgagcaggagcagcgccgccgcccagagcccggggaggcgtctgtgccaacgggcaggcgggctgggtccctcggcagtcatggtccgggagtgcgcgggccagcggactcgggtgagggctctggctgcgtttggggttgcccaggccactgcccagcgtgcgccactcggctctgcgctctgcgctcggctcacgaatcgcaggcttcgcgccgggcgcgccgagagggaggagcgcggagagccgggggaggctcgggacgcagagccggagcgcctgggccgccgaactcccgggggtcttctctgtggcgccgaggaggcggctgtaacccggctccgccttcgcgctgggcacctggaaacctcggtgccaaaaggggctgcgctgggccgcgcgctctgcgggtacagcggggcggagggcgagggcgcagggaggcggggagagtagctagccggccgcaaggagcccccgcccgtctgggggacccttggcgagagggtgacgcagtctgacaggcggagcccctccggcagggccgttagacaacgagtgtctaactctgtcctcggcctctacttttc

SEQ ID NO: 2219 - DNA, 240 bp, Homo sapiens
  chr3:38035773-38036013
  hyper
cgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctgg

SEQ ID NO: 2220 - DNA, 854 bp, Homo sapiens
  chr3:44036274-44037128
  hyper
gcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgc

SEQ ID NO: 2221 - DNA, 1765 bp, Homo sapiens
  chr3:44037129-44038894
  hyper
ggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagac

SEQ ID NO: 2222 - DNA, 602 bp, Homo sapiens
  chr3:44039424-44040026
  hyper
tgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcacca

SEQ ID NO: 2223 - DNA, 1039 bp, Homo sapiens
  chr3:44040056-44041095
  hyper
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcga

SEQ ID NO: 2224 - DNA, 321 bp, Homo sapiens; identical to SEQ ID NO: 295
  chr3:44063500-44063821
  hyper

SEQ ID NO: 2225 - DNA, 87 bp, Homo sapiens
  chr3:44626451-44626538
  hyper
acgcagttccttctgcgctttgttcaagatgtgggtctggcgctttcggtgaggggtgctctacagtctggcgtggggggtcgggcc

SEQ ID NO: 2226 - DNA, 13 bp, Homo sapiens
  chr3:44626539-44626552
  hyper
ggttctgggagcg

SEQ ID NO: 2227 - DNA, 409 bp, Homo sapiens; identical to SEQ ID NO: 296
  chr3:48693292-48693701
  hyper

SEQ ID NO: 2228 - DNA, 31 bp, Homo sapiens; identical to SEQ ID NO: 297
  chr3:48693851-48693882
  hyper

SEQ ID NO: 2229 - DNA, 272 bp, Homo sapiens; identical to SEQ ID NO: 298
  chr3:48693883-48694155
  hyper

SEQ ID NO: 2230 - DNA, 164 bp, Homo sapiens; identical to SEQ ID NO: 299
  chr3:48698847-48699011
  hyper

SEQ ID NO: 2231 - DNA, 363 bp, Homo sapiens; identical to SEQ ID NO: 300
  chr3:48699376-48699739
  hyper

SEQ ID NO: 2232 - DNA, 443 bp, Homo sapiens; identical to SEQ ID NO: 301
  chr3:62353488-62353931
  hyper

SEQ ID NO: 2233 - DNA, 168 bp, Homo sapiens
  chr3:62354625-62354793
  hyper
tacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcac

SEQ ID NO: 2234 - DNA, 40 bp, Homo sapiens
  chr3:62354899-62354939
  hyper
cggtggttgccctccttaggtctcccggagaaggggacgc

SEQ ID NO: 2235 - DNA, 446 bp, Homo sapiens; identical to SEQ ID NO: 302
  chr3:62355774-62356220
  hyper

SEQ ID NO: 2236 - DNA, 279 bp, Homo sapiens; identical to SEQ ID NO: 303
  chr3:62356366-62356645
  hyper

SEQ ID NO: 2237 - DNA, 367 bp, Homo sapiens; identical to SEQ ID NO: 304
  chr3:62356792-62357159
  hyper

SEQ ID NO: 2238 - DNA, 1051 bp, Homo sapiens; identical to SEQ ID NO: 305
  chr3:62359440-62360491
  hyper

SEQ ID NO: 2239 - DNA, 581 bp, Homo sapiens
  chr3:62363596-62364177
  hyper
caatacataacacagcgccctatgtatgccatctccccagggagccgagcagcttgggaggagaaggcttgcttgcggctcccgagtttggggaaacacgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatctgatttacttggtgccgcgcttaaccgctgctgaaaatagattaacttctgaagagaaattcttttgctatcctctcttttttccccaggaagcattttattgaaaacattcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagca

SEQ ID NO: 2240 - DNA, 373 bp, Homo sapiens
  chr3:62364753-62365126
  hyper
atctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 2241 - DNA, 31 bp, Homo sapiens; identical to SEQ ID NO: 306
  chr3:68980916-68980947
  hyper

SEQ ID NO: 2242 - DNA, 270 bp, Homo sapiens; identical to SEQ ID NO: 307
  chr3:68980948-68981218
  hyper

SEQ ID NO: 2243 - DNA, 118 bp, Homo sapiens
  chr3:85008597-85008715
  hyper
ccgccgatccgagtccgcgggttcgaacaccgcagcggtggggacggtgggtccggcgggcgccgggaggaggacaccagcggagccctgcactctcgtgccccgctcaccagcatct

SEQ ID NO: 2244 - DNA, 16 bp, Homo sapiens
  chr3:117715630-117715646
  hyper
gtcgccaccacctcgc

SEQ ID NO: 2245 - DNA, 358 bp, Homo sapiens
  chr3:117715766-117716124
  hyper
acacacacacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcg

SEQ ID NO: 2246 - DNA, 99 bp, Homo sapiens
  chr3:117716213-117716312
  hyper
cggcaacccggacagacaagcctcttgccgcacgacggccggatcccagaacagccttgctctcctcttcgggagcgcaagccaggggccgggatggac

SEQ ID NO: 2247 - DNA, 368 bp, Homo sapiens
  chr3:117716313-117716681
  hyper
ctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttgg

SEQ ID NO: 2248 - DNA, 39 bp, Homo sapiens
  chr3:120627972-120628011
  hyper
taaaatactctgagccgaacgtttcgaagaaggaaagtc

SEQ ID NO: 2249 - DNA, 173 bp, Homo sapiens; identical to SEQ ID NO: 308
  chr3:121902777-121902950
  hyper

SEQ ID NO: 2250 - DNA, 229 bp, Homo sapiens; identical to SEQ ID NO: 309
  chr3:121902990-121903219
  hyper

SEQ ID NO: 2251 - DNA, 325 bp, Homo sapiens; identical to SEQ ID NO: 310
  chr3:121903323-121903648
  hyper

SEQ ID NO: 2252 - DNA, 28 bp, Homo sapiens
  chr3:123166978-123167006
  hyper
gccgccgccgccgcccgcagggggcgcc

SEQ ID NO: 2253 - DNA, 430 bp, Homo sapiens
  chr3:123167300-123167730
  hyper
gcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgaggg

SEQ ID NO: 2254 - DNA, 386 bp, Homo sapiens
  chr3:127794474-127794860
  hyper
tgtgacttggaatctcggatccctgggctaggcctggccacgcccccatggggggaggggcagcgcggcgggggcggagcctgggcccgaaacgccacgggcgcgactctgtgcgcgtccgcccacacgggggcgctgtgtcctcgcaagctcccgcggggtgcctcgcggccctggaacgctgtggttttcgaggggaaaagtgagagtggctggtcctgcctccgctgccgcttggccctgagatccccactgcccacgggataggccccagtccacccagccggggccccccccttcccctcgtctcgctctccttggcagttcggacttcgggtcagtcccacactcgcgcccggctgtccctgctgcgctcctgtcactgg

SEQ ID NO: 2255 - DNA, 220 bp, Homo sapiens
  chr3:128273832-128274052
  hyper
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggagtcccgggaggggcagcggggacggggaccctgaggcccaggggattgggctcaggggcc

SEQ ID NO: 2256 - DNA, 347 bp, Homo sapiens
  chr3:128274308-128274655
  hyper
gctcctgtaacaggctggggcttggcccggcccgcggccgccccgccaggaagcgccccgtccgccccctcggggcgcgtccgcggcaggcacttttgaggacaggaaggggagaggtgacctgagcatccacgcagctgtggcattcggggacgggccgaggactgggtttcttgccatcctcagcgctgggggtgactccaagcccccgggtgggggtggggagtggccgggcatggcgcccggctccacaatgcatcgccttacccggccggaattcctgcaggacgctttgttctcagatggcagcgctgctagagccatcggacctgtgaggggggggcgcc

SEQ ID NO: 2257 - DNA, 184 bp, Homo sapiens
  chr3:128720163-128720347
  hyper
cgtgagtgaggagaggagagcgtgggagtcacgcggagaagccagacccagacgccgaccgggcactggtggcgctgccggggtcccgggggttcctggaccccctaccccaggcccctccaaagcaactggggtaaaccagacgcactgtgaggccagcgcagctgctggacacggtccccgg

SEQ ID NO: 2258 - DNA, 116 bp, Homo sapiens
  chr3:128720418-128720534
  hyper
cggggcgaagggaccggaggagggaccggaggagcgaggcgcgcggcgcagcgatggagccggtcagcacgggcgcggaggccggcatggagggcgcgggaggtgacccgtaccgg

SEQ ID NO: 2259 - DNA, 23 bp, Homo sapiens
  chr3:128720566-128720589
  hyper
cgccctggcgcaccactacgggc

SEQ ID NO: 2260 - DNA, 54 bp, Homo sapiens
  chr3:128720830-128720884
  hyper
cggggactcagataccgatgaagaggcgcgcctggcgctgcgcgccgagccgcc

SEQ ID NO: 2261 - DNA, 430 bp, Homo sapiens
  chr3:128720885-128721315
  hyper
gagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtgcgcgccggccacgaagggagggtggtaacgcccgggagagggctcgaactaaaagctggctggctgcggagcccgacaggacagagtcagaggaaggggagacagagggcagccccacaccatcccactccgcatcagcacactt

SEQ ID NO: 2262 - DNA, 82 bp, Homo sapiens
  chr3:128764525-128764607
  hyper
ctgggccctaagggccgggcctcgaccccccgcaggtccccgcggtcccggtcccccgcccgggacatctgatggaccgagc

SEQ ID NO: 2263 - DNA, 92 bp, Homo sapiens; identical to SEQ ID NO: 311
  chr3:129693108-129693200
  hyper

SEQ ID NO: 2264 - DNA, 195 bp, Homo sapiens; identical to SEQ ID NO: 312
  chr3:129693304-129693499
  hyper

SEQ ID NO: 2265 - DNA, 259 bp, Homo sapiens; identical to SEQ ID NO: 313
  chr3:129693954-129694213
  hyper

SEQ ID NO: 2266 - DNA, 93 bp, Homo sapiens
  chr3:130235834-130235927
  hyper
caagaggggagaagccggtggagcagtaacagccttcataatgtctccagtcccgcttccgtcacctccctaaggctgcgcccccctcctggg

SEQ ID NO: 2267 - DNA, 175 bp, Homo sapiens
  chr3:134515771-134515946
  hyper
aaactcccccaaacacgatggtttggtgccccccgccattccggaaagctctgcccttctggaagtgaagctggaggggcattccgggccctgaggcgcggctaagattcccttcccttttggcgaagaccaccgcatcccacgtttgttctggtggcggcgtgggggtgcggcg

SEQ ID NO: 2268 - DNA, 165 bp, Homo sapiens
  chr3:137479522-137479687
  hyper
ggccggagggtggggcggagccttgtggcaaggcaggtgggtgcaggcctctggggccccagactgccgcgtctggctctaccaggctgtgtctcgggccccgtgcctgcagctgcaaggcggggaaagacctatcgggaagatccacctcggcctgggcagaag

SEQ ID NO: 2269 - DNA, 698 bp, Homo sapiens; identical to SEQ ID NO: 314
  chr3:137479943-137480641
  hyper

SEQ ID NO: 2270 - DNA, 145 bp, Homo sapiens; identical to SEQ ID NO: 315
  chr3:137481170-137481315
  hyper

SEQ ID NO: 2271 - DNA, 283 bp, Homo sapiens
  chr3:137484405-137484688
  hyper
ctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 2272 - DNA, 519 bp, Homo sapiens; identical to SEQ ID NO: 316
  chr3:137488807-137489326
  hyper

SEQ ID NO: 2273 - DNA, 15 bp, Homo sapiens
  chr3:137489684-137489699
  hyper
agagaaagacctgac

SEQ ID NO: 2274 - DNA, 1135 bp, Homo sapiens; identical to SEQ ID NO: 318
  chr3:137489875-137491010
  hyper

SEQ ID NO: 2275 - DNA, 171 bp, Homo sapiens
  chr3:138657617-138657788
  hyper
cgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggg

SEQ ID NO: 2276 - DNA, 161 bp, Homo sapiens; identical to SEQ ID NO: 319
  chr3:138658703-138658864
  hyper

SEQ ID NO: 2277 - DNA, 93 bp, Homo sapiens
  chr3:138662087-138662180
  hyper
ccctgaggttcctaccgcctgaccactggagggctgaagtgagaggcctgcaggctcattcccgtggcgcaaaaccgctcctggcccaccagc

SEQ ID NO: 2278 - DNA, 167 bp, Homo sapiens
  chr3:138662281-138662448
  hyper
cgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatc

SEQ ID NO: 2279 - DNA, 42 bp, Homo sapiens
  chr3:138664141-138664183
  hyper
ggaaagagacgagcccagtagaaagcgcgcagagaggcagct

SEQ ID NO: 2280 - DNA, 303 bp, Homo sapiens
  chr3:138664928-138665231
  hyper
gggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaa

SEQ ID NO: 2281 - DNA, 668 bp, Homo sapiens; identical to SEQ ID NO: 320
  chr3:138665557-138666225
  hyper

SEQ ID NO: 2282 - DNA, 352 bp, Homo sapiens
  chr3:138668757-138669109
  hyper
cgccagggccggttccttttctccccgcggcattggggcgacgcagggcccccggcttagtgaccttggggcggcgctcacctccaaaggccagggtggtgggctgggcagaactcactgcctctttgccccagttttccagggtcccgcagctgcaattcagcagccaccggcgcctcctgaccgtggtcccaccgtagcgccgcctgcggatacggttccagtgaaccgccgattgagcgcagtctcagctcccgcgcctcctcgcagcctggccccgcgcctcggaggtcccgacagccggcgcgagcaatctacacggctctgatacagacgcttttctccccagggc

SEQ ID NO: 2283 - DNA, 196 bp, Homo sapiens
  chr3:138669140-138669336
  hyper
cgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagag

SEQ ID NO: 2284 - DNA, 105 bp, Homo sapiens; identical to SEQ ID NO: 321
  chr3:138679188-138679293
  hyper

SEQ ID NO: 2285 - DNA, 82 bp, Homo sapiens; identical to SEQ ID NO: 322
  chr3:139653491-139653573
  hyper

SEQ ID NO: 2286 - DNA, 298 bp, Homo sapiens; identical to SEQ ID NO: 323
  chr3:139653574-139653872
  hyper

SEQ ID NO: 2287 - DNA, 682 bp, Homo sapiens; identical to SEQ ID NO: 324
  chr3:139653873-139654555
  hyper

SEQ ID NO: 2288 - DNA, 674 bp, Homo sapiens; identical to SEQ ID NO: 325
  chr3:140769628-140770302
  hyper

SEQ ID NO: 2289 - DNA, 183 bp, Homo sapiens; identical to SEQ ID NO: 326
  chr3:140770407-140770590
  hyper

SEQ ID NO: 2290 - DNA, 40 bp, Homo sapiens; identical to SEQ ID NO: 327
  chr3:140770643-140770683
  hyper

SEQ ID NO: 2291 - DNA, 356 bp, Homo sapiens; identical to SEQ ID NO: 328
  chr3:140770684-140771040
  hyper

SEQ ID NO: 2292 - DNA, 355 bp, Homo sapiens; identical to SEQ ID NO: 329
  chr3:141516389-141516744
  hyper

SEQ ID NO: 2293 - DNA, 207 bp, Homo sapiens
  chr3:142838112-142838319
  hyper
gggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgca

SEQ ID NO: 2294 - DNA, 168 bp, Homo sapiens
  chr3:142838479-142838647
  hyper
cgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccgg

SEQ ID NO: 2295 - DNA, 160 bp, Homo sapiens
  chr3:142838876-142839036
  hyper
cgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtccc

SEQ ID NO: 2296 - DNA, 86 bp, Homo sapiens
  chr3:142839440-142839526
  hyper
ggagggagattggggcgcatccgctcactccgcttcccctcgcaggtcctacccggagccgctgccatgggagagccagccttggg

SEQ ID NO: 2297 - DNA, 16 bp, Homo sapiens
  chr3:142839562-142839578
  hyper
cggcccgagtcccggc

SEQ ID NO: 2298 - DNA, 110 bp, Homo sapiens
  chr3:142839579-142839689
  hyper
ccagcagccagcccgctgcgtccccttcccgggctgcagggctgcctccgccgcgccgccggcccggattgtgcctgtgatgagccgcagcccgcagcgagctctgcccc

SEQ ID NO: 2299 - DNA, 119 bp, Homo sapiens
  chr3:142839783-142839902
  hyper
cgcgtcccctctcggaatgaaggtgttccgtaggaaggcgctggtgttgtgcgcgggctatgcactgctgctggtgctcactatgctcaacctcctggactacaagtggcacaaggagc

SEQ ID NO: 2300 - DNA, 47 bp, Homo sapiens
  chr3:142839944-142839991
  hyper
cgggggcagccggaggcagctgggggcgcccagggccgcctccggcc

SEQ ID NO: 2301 - DNA, 136 bp, Homo sapiens
  chr3:142839992-142840128
  hyper
ggccgccccgtgctcatgcccgtttggacctccgcactccttaccgccctcccgctgccgccgtcggggcggctcctgcagccgcggcagggatggcgggggttgcggcccctccaggcaatggcactcggggcac

SEQ ID NO: 2302 - DNA, 33 bp, Homo sapiens
  chr3:142840221-142840254
  hyper
cgaggtgttctttctctacgagccagtgtggca

SEQ ID NO: 2303 - DNA, 229 bp, Homo sapiens; identical to SEQ ID NO: 330
  chr3:147078959-147079188
  hyper

SEQ ID NO: 2304 - DNA, 90 bp, Homo sapiens
  chr3:147108806-147108896
  hyper
ggcagacggtgtagccgaatcgtagccagagctgggcggcggcgagcgcccgtgcaccttcatgtgcttacgcagcgagctggggtgcgt

SEQ ID NO: 2305 - DNA, 387 bp, Homo sapiens
  chr3:147109225-147109612
  hyper
cgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgt

SEQ ID NO: 2306 - DNA, 497 bp, Homo sapiens; identical to SEQ ID NO: 331
  chr3:147110228-147110725
  hyper

SEQ ID NO: 2307 - DNA, 231 bp, Homo sapiens
  chr3:147138768-147138999
  hyper
aggactccaagctaacgatgacctgtgtgggccttgctctgaacagaaaactcaaactcagcgtgggttcccgcgtcttccccaaaaggccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgc

SEQ ID NO: 2308 - DNA, 226 bp, Homo sapiens
  chr3:153839727-153839953
  hyper
taggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggaggga

SEQ ID NO: 2309 - DNA, 236 bp, Homo sapiens; identical to SEQ ID NO: 332
  chr3:156009064-156009300
  hyper

SEQ ID NO: 2310 - DNA, 265 bp, Homo sapiens; identical to SEQ ID NO: 333
  chr3:156009318-156009583
  hyper

SEQ ID NO: 2311 - DNA, 101 bp, Homo sapiens
  chr3:157812157-157812258
  hyper
aggaggcaagggcgccgcgagctccccggatgcactggtcccacaggccgtgcccgagtggagcactgcgaatggggccaagaaattttggcctttctcgc

SEQ ID NO: 2312 - DNA, 209 bp, Homo sapiens
  chr3:157812436-157812645
  hyper
cgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacag

SEQ ID NO: 2313 - DNA, 60 bp, Homo sapiens
  chr3:157812973-157813033
  hyper
ctctttcagtctttgcggaaggtcccgtcatcacaagagcccgcgcgggaaggaaagttc

SEQ ID NO: 2314 - DNA, 4 bp, Homo sapiens
  chr3:157813601-157813605
  hyper
gggc

SEQ ID NO: 2315 - DNA, 126 bp, Homo sapiens
  chr3:157821536-157821662
  hyper
gcagactcgaccctaaacgcttaacccacagagatcaacaggttcaagcggaatattcgcgatcctcggtttctattggttgctcaaagccttttcatgcaaccagcagctcggatgtttaataaa

SEQ ID NO: 2316 - DNA, 59 bp, Homo sapiens
  chr3:157825176-157825235
  hyper
aaagtgtttccttagcgcccggtcaaggacagctcgacttcgttcgtttcctctctgag

SEQ ID NO: 2317 - DNA, 342 bp, Homo sapiens
  chr3:172165443-172165785
  hyper
tgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgct

SEQ ID NO: 2318 - DNA, 368 bp, Homo sapiens
  chr3:172165866-172166234
  hyper
cgccgaagttccagggccggtactgccagaggcgaacgaggtccaggggcatgcagaggaagatgagcagatcggagaaggccatgctggacaggtagaggttggtggtggtgcgcagctcgcggaagcgcgacaccaccagcatggtgagcaggttgccagcgatgcccaccacgaagagtgccacgcaggtggctgtgacgcccgccagcagcggcgcggggaagagctgcagcagctcgtcgcccagcgagtcgttgccgggggaagcatcccagtccaggtcggccagtgtgaggttgaaccccggctcttcgctgggcgtcgcgttccacatgctgccggctcagctgaacaggctctgggac

SEQ ID NO: 2319 - DNA, 49 bp, Homo sapiens
  chr3:172166235-172166284
  hyper
tgactgcgctgggaggctggaccgagctggctcccgaggaggtccgctt

SEQ ID NO: 2320 - DNA, 257 bp, Homo sapiens
  chr3:172167660-172167917
  hyper
cagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 2321 - DNA, 120 bp, Homo sapiens
  chr3:173115047-173115167
  hyper
tttgccagagttgagcgagacgaagccgtgtctaaataagtacatgacactaaatttccttttaaatccaccttttacaccatggccagtcgcttgtttaactcccgttcaagggacacg

SEQ ID NO: 2322 - DNA, 283 bp, Homo sapiens
  chr3:173302927-173303210
  hyper
aatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgt

SEQ ID NO: 2323 - DNA, 858 bp, Homo sapiens; identical to SEQ ID NO: 334
  chr3:179168782-179169640
  hyper

SEQ ID NO: 2324 - DNA, 255 bp, Homo sapiens; identical to SEQ ID NO: 335
  chr3:179754505-179754760
  hyper

SEQ ID NO: 2325 - DNA, 70 bp, Homo sapiens; identical to SEQ ID NO: 336
  chr3:179754803-179754873
  hyper

SEQ ID NO: 2326 - DNA, 286 bp, Homo sapiens; identical to SEQ ID NO: 337
  chr3:179755086-179755372
  hyper

SEQ ID NO: 2327 - DNA, 27 bp, Homo sapiens
  chr3:181413421-181413448
  hyper
gacccacccagccgggcccgatccctc

SEQ ID NO: 2328 - DNA, 483 bp, Homo sapiens
  chr3:181419975-181420458
  hyper
gcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctg

SEQ ID NO: 2329 - DNA, 743 bp, Homo sapiens; identical to SEQ ID NO: 338
  chr3:181421539-181422282
  hyper

SEQ ID NO: 2330 - DNA, 422 bp, Homo sapiens
  chr3:181428388-181428810
  hyper
ctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttc

SEQ ID NO: 2331 - DNA, 348 bp, Homo sapiens
  chr3:181430741-181431089
  hyper
ccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccct

SEQ ID NO: 2332 - DNA, 729 bp, Homo sapiens; identical to SEQ ID NO: 339
  chr3:181441019-181441748
  hyper

SEQ ID NO: 2333 - DNA, 448 bp, Homo sapiens; identical to SEQ ID NO: 340
  chr3:181441962-181442410
  hyper

SEQ ID NO: 2334 - DNA, 536 bp, Homo sapiens
  chr3:181443014-181443550
  hyper
gaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccac

SEQ ID NO: 2335 - DNA, 91 bp, Homo sapiens
  chr3:181444434-181444525
  hyper
cacgtgctgtgccttcgaaacgccgccgcgggccctgcctttcagagctgcggcagccggggctggcgtggagggggcgctgaaacaccgg

SEQ ID NO: 2336 - DNA, 157 bp, Homo sapiens
  chr3:181444612-181444769
  hyper
cgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgcatc

SEQ ID NO: 2337 - DNA, 120 bp, Homo sapiens
  chr3:181444829-181444949
  hyper
gcgtcttgcgcagcgcagacacctccactctggattgaaacgaaaaagctcgcggtaagagcagaaaattggtctattgatacattcgctccgagtgttgatcttggcatcaccgatagc

SEQ ID NO: 2338 - DNA, 1 bp, Homo sapiens
  chr3:181444988-181444989
  hyper
c

SEQ ID NO: 2339 - DNA, 474 bp, Homo sapiens
  chr3:181444990-181445464
  hyper
cggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacc

SEQ ID NO: 2340 - DNA, 15 bp, Homo sapiens
  chr3:181445710-181445725
  hyper
cgtaacaccatcatc

SEQ ID NO: 2341 - DNA, 62 bp, Homo sapiens
  chr3:181445799-181445861
  hyper
cggccagtctcagtttttctctgaataatccctgagggtaagtcctccgggcttttaaagag

SEQ ID NO: 2342 - DNA, 127 bp, Homo sapiens
  chr3:186079204-186079331
  hyper
attctctgaggtgtccgtgttcgcttcagcttccctttaagtcgccctgcgcaggggctttgtggagtgcccccaaagtcctagaaccccgcgggacggtcggaggctttggcggccagacattagg

SEQ ID NO: 2343 - DNA, 130 bp, Homo sapiens; identical to SEQ ID NO: 341
  chr3:187387791-187387921
  hyper

SEQ ID NO: 2344 - DNA, 183 bp, Homo sapiens; identical to SEQ ID NO: 342
  chr3:187388006-187388189
  hyper

SEQ ID NO: 2345 - DNA, 406 bp, Homo sapiens; identical to SEQ ID NO: 343
  chr3:192126305-192126711
  hyper

SEQ ID NO: 2346 - DNA, 63 bp, Homo sapiens; identical to SEQ ID NO: 344
  chr3:192126786-192126849
  hyper

SEQ ID NO: 2347 - DNA, 110 bp, Homo sapiens; identical to SEQ ID NO: 345
  chr3:192126850-192126960
  hyper

SEQ ID NO: 2348 - DNA, 49 bp, Homo sapiens; identical to SEQ ID NO: 346
  chr3:192126961-192127010
  hyper

SEQ ID NO: 2349 - DNA, 59 bp, Homo sapiens; identical to SEQ ID NO: 347
  chr3:192127314-192127373
  hyper

SEQ ID NO: 2350 - DNA, 175 bp, Homo sapiens; identical to SEQ ID NO: 348
  chr3:192127556-192127731
  hyper

SEQ ID NO: 2351 - DNA, 54 bp, Homo sapiens; identical to SEQ ID NO: 349
  chr3:192127936-192127990
  hyper

SEQ ID NO: 2352 - DNA, 100 bp, Homo sapiens
  chr3:194208467-194208567
  hyper
cgcgcccggccacctgcagcctctggctgcggccatctttccgcctggggccacctggcctgcgccctttgtgcccggcccgctccgtgactgttcttct

SEQ ID NO: 2353 - DNA, 342 bp, Homo sapiens
  chr3:194408427-194408769
  hyper
agcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgc

SEQ ID NO: 2354 - DNA, 220 bp, Homo sapiens
  chr3:194408838-194409058
  hyper
cgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgaga

SEQ ID NO: 2355 - DNA, 114 bp, Homo sapiens
  chr4:568539-568653
  hyper
gaggctgcaaagccacgtggaagaggcggcgcccctgaggcctggccctggaccccgccccgctgcccgtcctcccttgccgcgggggtcctgagcggggcggggtgggtggaa

SEQ ID NO: 2356 - DNA, 69 bp, Homo sapiens
  chr4:569047-569116
  hyper
ggagccgccgcggggccgcgccagggcccggcctcccctccgcctgccgcgccgaccgcgccgggcctg

SEQ ID NO: 2357 - DNA, 162 bp, Homo sapiens
  chr4:569274-569436
  hyper
cgccgggggccgagcccggcgccgagccgggggccgagcccggggccgagccgggggttgagcccggggccgagccggggctcgaacctggcgcccgcgggggcaggcagtagtgcgagtacttgcgctccaccagggacacggtgtcgccgtcgatcacgg

SEQ ID NO: 2358 - DNA, 36 bp, Homo sapiens
  chr4:569460-569496
  hyper
cgagcatgaagaccaggacgccgagcagaagcaggt

SEQ ID NO: 2359 - DNA, 853 bp, Homo sapiens
  chr4:570836-571689
  hyper
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagacccca

SEQ ID NO: 2360 - DNA, 14 bp, Homo sapiens
  chr4:2042655-2042669
  hyper
gcagtcccagcttg

SEQ ID NO: 2361 - DNA, 183 bp, Homo sapiens
  chr4:3769007-3769190
  hyper
catgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccgga

SEQ ID NO: 2362 - DNA, 238 bp, Homo sapiens
  chr4:4868555-4868793
  hyper
ctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 2363 - DNA, 172 bp, Homo sapiens
  chr4:4868828-4869000
  hyper
cggatcgctgaacccggggctgaaggaccagattgagcaggaggcccagtgaggacagttactggtgaggcaggggccccgagtgcgaatcctaccgctgcgccctccttagtgacccaaggccgggaggtgagcccagccgggtccaggcctgcgccccgcctagagccct

SEQ ID NO: 2364 - DNA, 127 bp, Homo sapiens
  chr4:4869131-4869258
  hyper
cgcatcgccccacagtggaacagtcccccggccccgacgccggactccctgggaagcccccgacccccaagtgccaccaccaagtgcccactctccagagcactcccaggcccccactccagacttg

SEQ ID NO: 2365 - DNA, 1175 bp, Homo sapiens
  chr4:5052930-5054105
  hyper
gacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 2366 - DNA, 253 bp, Homo sapiens
  chr4:5712979-5713232
  hyper
aggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcct

SEQ ID NO: 2367 - DNA, 116 bp, Homo sapiens
  chr4:5891966-5892082
  hyper
caagggacaagaccacgtgcgtatcagggggaggagcatccgcctgccactggccaaacagatcgctgctcccaagcagatttcgccggtacaaagcgccgcagccgctcagcctc

SEQ ID NO: 2368 - DNA, 56 bp, Homo sapiens
  chr4:5892109-5892165
  hyper
cgcagaaacccctcctgcagcccagggagaagcctggtgggcggggggggaagggc

SEQ ID NO: 2369 - DNA, 645 bp, Homo sapiens
  chr4:6201895-6202540
  hyper
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgc

SEQ ID NO: 2370 - DNA, 290 bp, Homo sapiens; identical to SEQ ID NO: 350
  chr4:8858758-8859048
  hyper

SEQ ID NO: 2371 - DNA, 557 bp, Homo sapiens; identical to SEQ ID NO: 351
  chr4:8859381-8859938
  hyper

SEQ ID NO: 2372 - DNA, 156 bp, Homo sapiens; identical to SEQ ID NO: 352
  chr4:8869115-8869271
  hyper

SEQ ID NO: 2373 - DNA, 445 bp, Homo sapiens; identical to SEQ ID NO: 353
  chr4:8869368-8869813
  hyper

SEQ ID NO: 2374 - DNA, 116 bp, Homo sapiens
  chr4:8894842-8894958
  hyper
ggggagagtccatgccgcgacggagcgagcagacttggacatggtcgagtgcctggtgcgcacgattggtcttaagagtttagggaaaaaagcacgcggggaaaccacgcggggcc

SEQ ID NO: 2375 - DNA, 134 bp, Homo sapiens
  chr4:8895964-8896098
  hyper
cgcagccaggtttctccgctgccgtcctcttccagggccaaggggccgtggcagacccggagcctcccggaggcgcttctgccggggcggattatctcccctctcccaccaggccccggcggggggcaccaact

SEQ ID NO: 2376 - DNA, 205 bp, Homo sapiens
  chr4:8896117-8896322
  hyper
cgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtccc

SEQ ID NO: 2377 - DNA, 726 bp, Homo sapiens
  chr4:10458395-10459121
  hyper
ctcagctccgaggcccgcaggaggctttaaaaatggcctcctgacgacacttcctgctcggcgcggacggtaggagccctcggaggaggcatccttcataacgctgggggcggggagcgcaggccgggccagcggcgccacacgaacggccccgcgggacgctgccacccccgcctcggtcgccccggcgcgtcggccgagtccgcggggtcgcggcgcacaaaggcgagctgggggcgccgggccggaccccgaccctaggccaggcccgcgtacctgctcaacgcgcgccaagccgcggcccgggcccccaccccagccggtgccccacgcccaccagccggagcccgcgttcggcctacccggtgccacttgccacgacgccagccctcagcgcgggcacgcggggccgcggccgctcgacccgccccggcctggccccgtcaggcccccgccccgcgcgcccccacgacccggccgcagctggcgcttcggtcacgtacacgcggatccgggggccctcgccctcccgctcagctacttacccggcaggccggattcgggtgccaggtcccggcgaaggggcgtctacaccgccggccgcagaccgccggcgccgcgcccgctgtaggtccctacccggggggcggagcccgcgccagccccgcgcgtgcgcaatgtgaagcggcggcgcggctccagcgaggccggcgcctgaggtctcta

SEQ ID NO: 2378 - DNA, 273 bp, Homo sapiens; identical to SEQ ID NO: 354
  chr4:10462775-10463048
  hyper

SEQ ID NO: 2379 - DNA, 184 bp, Homo sapiens; identical to SEQ ID NO: 355
  chr4:10463072-10463256
  hyper

SEQ ID NO: 2380 - DNA, 280 bp, Homo sapiens; identical to SEQ ID NO: 356
  chr4:10463257-10463537
  hyper

SEQ ID NO: 2381 - DNA, 83 bp, Homo sapiens; identical to SEQ ID NO: 357
  chr4:13545940-13546023
  hyper

SEQ ID NO: 2382 - DNA, 35 bp, Homo sapiens; identical to SEQ ID NO: 358
  chr4:13548555-13548590
  hyper

SEQ ID NO: 2383 - DNA, 328 bp, Homo sapiens; identical to SEQ ID NO: 359
  chr4:13548634-13548962
  hyper

SEQ ID NO: 2384 - DNA, 78 bp, Homo sapiens
  chr4:16084741-16084819
  hyper
gtgttggcccatttccgcactcagccagggaagctcagcgcctcacgtccccggggccatccctagagtttcctttac

SEQ ID NO: 2385 - DNA, 14 bp, Homo sapiens
  chr4:16085166-16085180
  hyper
cgcagagcgaaccc

SEQ ID NO: 2386 - DNA, 121 bp, Homo sapiens
  chr4:16085181-16085302
  hyper
tccactcctcactgtacacccccagtacagtggaaggagtgcgctcagccccgcgcctggtcagcagatgcctctctcgctccgggatgaggacccagctactcaccgtgcacccggctcc

SEQ ID NO: 2387 - DNA, 48 bp, Homo sapiens
  chr4:16085351-16085399
  hyper
cgccagaccctggctcgtgaattatttatgacccggcttctgggacca

SEQ ID NO: 2388 - DNA, 291 bp, Homo sapiens
  chr4:17783003-17783294
  hyper
agcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 2389 - DNA, 27 bp, Homo sapiens
  chr4:17783295-17783322
  hyper
gtgggcgggcactgcgctcttggacac

SEQ ID NO: 2390 - DNA, 158 bp, Homo sapiens
  chr4:17783323-17783481
  hyper
tgggtggcgcgcggccctggacttggtggcgacggaccctgcccgaggtggggatcccaggctaaagaggaagaagagcctccggagagggacagggcacagtgactggcggcctccggagagggacagggcacagtgactggcggctcccgagtctc

SEQ ID NO: 2391 - DNA, 45 bp, Homo sapiens
  chr4:37245537-37245582
  hyper
gaacccacaccctcccgcccggcccaggtgcgcacccggccgcgc

SEQ ID NO: 2392 - DNA, 525 bp, Homo sapiens
  chr4:37245836-37246361
  hyper
cgccaggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccgg

SEQ ID NO: 2393 - DNA, 211 bp, Homo sapiens
  chr4:37246489-37246700
  hyper
cgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggc

SEQ ID NO: 2394 - DNA, 111 bp, Homo sapiens
  chr4:37247015-37247126
  hyper
gctggccggttttgcctgcacacttctattaggacacccattctccaccccgggttattcccctgggtcaatccaagaaacatccaaggcattagccggcccttctggaag

SEQ ID NO: 2395 - DNA, 73 bp, Homo sapiens; identical to SEQ ID NO: 360
  chr4:41258716-41258789
  hyper

SEQ ID NO: 2396 - DNA, 381 bp, Homo sapiens; identical to SEQ ID NO: 361
  chr4:41259085-41259466
  hyper

SEQ ID NO: 2397 - DNA, 333 bp, Homo sapiens; identical to SEQ ID NO: 362
  chr4:41750266-41750599
  hyper

SEQ ID NO: 2398 - DNA, 758 bp, Homo sapiens
  chr4:41752954-41753712
  hyper
gcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggcc

SEQ ID NO: 2399 - DNA, 90 bp, Homo sapiens
  chr4:41753713-41753803
  hyper
gggagggtgcccggggggcggtcaaggggcaggcccggggctctgtccctcccggtcctggggtcccttcccgtcccgcggttccggaac

SEQ ID NO: 2400 - DNA, 113 bp, Homo sapiens
  chr4:41753804-41753917
  hyper
cctcgccagccctctctgggcgccccctgctgccgggcgccccctgctgccggccgccccgggtcggggtgccgtgagccttctcgcctttgtaccaggagacctttcagcgc

SEQ ID NO: 2401 - DNA, 41 bp, Homo sapiens
  chr4:41754030-41754071
  hyper
cgtccctctgcccgtcttttgtggcccggggtcctgcttct

SEQ ID NO: 2402 - DNA, 341 bp, Homo sapiens; identical to SEQ ID NO: 363
  chr4:41875410-41875751
  hyper

SEQ ID NO: 2403 - DNA, 46 bp, Homo sapiens
  chr4:41881385-41881431
  hyper
ccaataaatgcaacccggcgccactcgattccgggataatttttaa

SEQ ID NO: 2404 - DNA, 689 bp, Homo sapiens; identical to SEQ ID NO: 364
  chr4:41882935-41883624
  hyper

SEQ ID NO: 2405 - DNA, 451 bp, Homo sapiens; identical to SEQ ID NO: 365
  chr4:42152961-42153412
  hyper

SEQ ID NO: 2406 - DNA, 101 bp, Homo sapiens; identical to SEQ ID NO: 366
  chr4:42153532-42153633
  hyper

SEQ ID NO: 2407 - DNA, 504 bp, Homo sapiens; identical to SEQ ID NO: 367
  chr4:42153881-42154385
  hyper

SEQ ID NO: 2408 - DNA, 611 bp, Homo sapiens; identical to SEQ ID NO: 368
  chr4:42154386-42154997
  hyper

SEQ ID NO: 2409 - DNA, 127 bp, Homo sapiens
  chr4:44450050-44450177
  hyper
cgctctggcagccctcgtcgttgagagagttctgcttggtgaccttgggcgacagcagcttgaccaagtcggtgagctggaaatactcggcctcgcgcagcagccgctccttctcggggaagtgctc

SEQ ID NO: 2410 - DNA, 223 bp, Homo sapiens
  chr4:44450741-44450964
  hyper
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgc

SEQ ID NO: 2411 - DNA, 660 bp, Homo sapiens
  chr4:46995161-46995821
  hyper
gcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 2412 - DNA, 567 bp, Homo sapiens
  chr4:46995822-46996389
  hyper
gcttcgcagcccccgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 2413 - DNA, 16 bp, Homo sapiens
  chr4:48485273-48485289
  hyper
ttcacaggaggggacc

SEQ ID NO: 2414 - DNA, 216 bp, Homo sapiens
  chr4:48485589-48485805
  hyper
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcgg

SEQ ID NO: 2415 - DNA, 162 bp, Homo sapiens
  chr4:54967330-54967492
  hyper
gggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagg

SEQ ID NO: 2416 - DNA, 130 bp, Homo sapiens; identical to SEQ ID NO: 369
  chr4:54975802-54975932
  hyper

SEQ ID NO: 2417 - DNA, 126 bp, Homo sapiens; identical to SEQ ID NO: 370
  chr4:54975990-54976116
  hyper

SEQ ID NO: 2418 - DNA, 1 bp, Homo sapiens
  chr4:57521395-57521396
  hyper
t

SEQ ID NO: 2419 - DNA, 159 bp, Homo sapiens; identical to SEQ ID NO: 372
  chr4:57521505-57521664
  hyper

SEQ ID NO: 2420 - DNA, 683 bp, Homo sapiens; identical to SEQ ID NO: 373
  chr4:57521700-57522383
  hyper

SEQ ID NO: 2421 - DNA, 396 bp, Homo sapiens; identical to SEQ ID NO: 374
  chr4:57522419-57522815
  hyper

SEQ ID NO: 2422 - DNA, 184 bp, Homo sapiens
  chr4:62067440-62067624
  hyper
gagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 2423 - DNA, 218 bp, Homo sapiens
  chr4:81106163-81106381
  hyper
gggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtg

SEQ ID NO: 2424 - DNA, 279 bp, Homo sapiens
  chr4:81123625-81123904
  hyper
tagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcac

SEQ ID NO: 2425 - DNA, 347 bp, Homo sapiens
  chr4:81124121-81124468
  hyper
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacct

SEQ ID NO: 2426 - DNA, 65 bp, Homo sapiens
  chr4:81951421-81951486
  hyper
gcaggtgcaggggcccgcagtgtccgtcagaagaggctcgggaaagtaagcgagaatggtgttca

SEQ ID NO: 2427 - DNA, 659 bp, Homo sapiens
  chr4:85402764-85403423
  hyper
cggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgt

SEQ ID NO: 2428 - DNA, 30 bp, Homo sapiens; identical to SEQ ID NO: 375
  chr4:85404111-85404141
  hyper

SEQ ID NO: 2429 - DNA, 252 bp, Homo sapiens; identical to SEQ ID NO: 376
  chr4:85404224-85404476
  hyper

SEQ ID NO: 2430 - DNA, 44 bp, Homo sapiens; identical to SEQ ID NO: 377
  chr4:85404649-85404693
  hyper

SEQ ID NO: 2431 - DNA, 121 bp, Homo sapiens
  chr4:85414725-85414846
  hyper
gaggggaggcaagggcgaggaattaaacgagcagatccaggccatgctaccactcccgcatctcgatggccctcccgcggccccccgaaggcctgctgccctccctcgcagccctcccttt

SEQ ID NO: 2432 - DNA, 123 bp, Homo sapiens; identical to SEQ ID NO: 378
  chr4:85419120-85419243
  hyper

SEQ ID NO: 2433 - DNA, 262 bp, Homo sapiens
  chr4:85422188-85422450
  hyper
taaggtgaagtccttcgtcagcatgaatagtgctaaggagtcaagccaagacttgcttcagaagagagctgatgtgcggaccttctgcatttccacgcggggatccagtgcttgggtctaaaccccagcgccctgccacctcggccaggaagctgcgggaggatggtggcaggcatagcccgtcctagccttgaaactggggggcctatgtctctggcttcgttacaaacgaaacgtttctcgccttcggacactccaccct

SEQ ID NO: 2434 - DNA, 40 bp, Homo sapiens
  chr4:90758843-90758883
  hyper
ggtcacaggttacaacgttaggggtcgctttagttcaaat

SEQ ID NO: 2435 - DNA, 133 bp, Homo sapiens
  chr4:94750906-94751039
  hyper
cagccccagcttctgcgggagggtactcggtgcagctggacgctctgcacttctcgactttcgaggacagcgccctgacagcgatgatggcgcaaaagaatttgtctccttctctccccgggagcatcttgca

SEQ ID NO: 2436 - DNA, 221 bp, Homo sapiens
  chr4:101111366-101111587
  hyper
actaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcac

SEQ ID NO: 2437 - DNA, 365 bp, Homo sapiens; identical to SEQ ID NO: 379
  chr4:107955250-107955615
  hyper

SEQ ID NO: 2438 - DNA, 357 bp, Homo sapiens
  chr4:107956676-107957033
  hyper
ctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtg

SEQ ID NO: 2439 - DNA, 306 bp, Homo sapiens
  chr4:111532704-111533010
  hyper
cgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgc

SEQ ID NO: 2440 - DNA, 114 bp, Homo sapiens
  chr4:111543232-111543346
  hyper
agaactaaagggatgcggggtagtcaaaattccggctcccggaagttctgcggggagccaggcgaacgaccactcccaccacgcctccccccggaggggctgacttccttgggg

SEQ ID NO: 2441 - DNA, 47 bp, Homo sapiens
  chr4:111543403-111543450
  hyper
cgccttacctgcggcctccgggctggaggtgtcggagatggtgtgca

SEQ ID NO: 2442 - DNA, 105 bp, Homo sapiens
  chr4:111544076-111544181
  hyper
tgcggcggcagcagccgctgcagccacgacgcggccctctgagcgcaccctccgcaacgcgcacacgcacacccctcgggcggtcgaacaggagccgggccttgc

SEQ ID NO: 2443 - DNA, 285 bp, Homo sapiens
  chr4:111544298-111544583
  hyper
cgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggaga

SEQ ID NO: 2444 - DNA, 45 bp, Homo sapiens
  chr4:113431810-113431855
  hyper
tttcttttgcagattcggaggccgggactttcacgctcccgggag

SEQ ID NO: 2445 - DNA, 240 bp, Homo sapiens
  chr4:113431915-113432155
  hyper
cgcttgggagcccgagggggctcggggaagaccgaggctggcggtgaggaggaggcgcttttaaccggttccaggtgtcggtgcccagaagtcacaaccagctcaagggtgtgcaatgcaggggggtgtacccagcgggtgggggcgccgcagctcccagcctcgccctcaagcccggccctttagcagcctgtgacccagactggcgggtgggcagctgaagccggccttgggtctaaa

SEQ ID NO: 2446 - DNA, 114 bp, Homo sapiens
  chr4:113432226-113432340
  hyper
cgcccagggccttcgcctcagctgggacaccaggagcgcccatccggctctggtccaggtgctgcgggcccgggaagcctcagcccctcctcctgcctccggctgagcctaggt

SEQ ID NO: 2447 - DNA, 239 bp, Homo sapiens; identical to SEQ ID NO: 380
  chr4:113441947-113442186
  hyper

SEQ ID NO: 2448 - DNA, 237 bp, Homo sapiens; identical to SEQ ID NO: 381
  chr4:113442246-113442483
  hyper

SEQ ID NO: 2449 - DNA, 275 bp, Homo sapiens; identical to SEQ ID NO: 382
  chr4:113444020-113444295
  hyper

SEQ ID NO: 2450 - DNA, 133 bp, Homo sapiens; identical to SEQ ID NO: 383
  chr4:113444296-113444429
  hyper

SEQ ID NO: 2451 - DNA, 251 bp, Homo sapiens; identical to SEQ ID NO: 384
  chr4:122301462-122301713
  hyper

SEQ ID NO: 2452 - DNA, 48 bp, Homo sapiens; identical to SEQ ID NO: 385
  chr4:122301962-122302010
  hyper

SEQ ID NO: 2453 - DNA, 244 bp, Homo sapiens; identical to SEQ ID NO: 386
  chr4:122686209-122686453
  hyper

SEQ ID NO: 2454 - DNA, 16 bp, Homo sapiens
  chr4:122686454-122686470
  hyper
gcgcagactctcccag

SEQ ID NO: 2455 - DNA, 1201 bp, Homo sapiens
  chr4:122871251-122872452
  hyper
ctccatttcctgggccgtttccattccacgcttatcttcagcaataactgaaccacatcgggatgcgtcgctcatttaaaatcagaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgtctcgcactgattaaaagctgtctccaagattggaaattaagaaaagttgctctttctcatgcattagcgcgccgaccgctccttcgtttagaaagagagagagggaaagaaagaaagagaaaaagagagcccgcgcgccggggcgcgagccgctgaccctgcaccgcctgggaaccgcagtcaaagttatcactaaagcggttccccggctgcccgatgcccactctctccctcaggggaccctatagggcttcggttccagttttaccccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcct

SEQ ID NO: 2456 - DNA, 761 bp, Homo sapiens; identical to SEQ ID NO: 388
  chr4:134071850-134072611
  hyper

SEQ ID NO: 2457 - DNA, 304 bp, Homo sapiens; identical to SEQ ID NO: 389
  chr4:134072676-134072980
  hyper

SEQ ID NO: 2458 - DNA, 301 bp, Homo sapiens
  chr4:134073340-134073641
  hyper
cgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactc

SEQ ID NO: 2459 - DNA, 565 bp, Homo sapiens; identical to SEQ ID NO: 390
  chr4:140200592-140201157
  hyper

SEQ ID NO: 2460 - DNA, 270 bp, Homo sapiens; identical to SEQ ID NO: 391
  chr4:140201192-140201462
  hyper

SEQ ID NO: 2461 - DNA, 510 bp, Homo sapiens; identical to SEQ ID NO: 392
  chr4:141418921-141419431
  hyper

SEQ ID NO: 2462 - DNA, 104 bp, Homo sapiens; identical to SEQ ID NO: 393
  chr4:144621336-144621440
  hyper

SEQ ID NO: 2463 - DNA, 383 bp, Homo sapiens; identical to SEQ ID NO: 394
  chr4:144621514-144621897
  hyper

SEQ ID NO: 2464 - DNA, 173 bp, Homo sapiens; identical to SEQ ID NO: 395
  chr4:144621981-144622154
  hyper

SEQ ID NO: 2465 - DNA, 30 bp, Homo sapiens
  chr4:147558352-147558382
  hyper
ctccaccgccgcttccgggagctgaccacc

SEQ ID NO: 2466 - DNA, 140 bp, Homo sapiens
  chr4:147558476-147558616
  hyper
cgccttccccaggcgcccagtgcctgcacctgctcccggtcaacccccgtccggattgggccacccgcgggttcctgcgtcggggtcccggggccttctcaccctcgcctgcaccctgctccttccgctctctagggagg

SEQ ID NO: 2467 - DNA, 889 bp, Homo sapiens; identical to SEQ ID NO: 396
  chr4:147559190-147560079
  hyper

SEQ ID NO: 2468 - DNA, 286 bp, Homo sapiens; identical to SEQ ID NO: 397
  chr4:147560133-147560419
  hyper

SEQ ID NO: 2469 - DNA, 52 bp, Homo sapiens; identical to SEQ ID NO: 398
  chr4:147560459-147560511
  hyper

SEQ ID NO: 2470 - DNA, 515 bp, Homo sapiens
  chr4:147576329-147576844
  hyper
gggggcccctctggggccgcctggactcgcaggtctcccgcgccaccccctaccccattccccgcctgcgccccctgctgcgctcggcgcgcgtcctgctgcagcctgctggggacagcgcacgcagtgaccgggcgcggcagccgcttccctttcccatcgacctcgctgccttctggcttttctcaaagccttttctccagagccagacagcagacgccccggcgatgccttcgccgcccatttggccgaggtagcccaggcctgcccttgctgcctccgccggccgctccgccgcggcccaaagccggggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 2471 - DNA, 135 bp, Homo sapiens; identical to SEQ ID NO: 399
  chr4:154709476-154709611
  hyper

SEQ ID NO: 2472 - DNA, 70 bp, Homo sapiens; identical to SEQ ID NO: 400
  chr4:154709758-154709828
  hyper

SEQ ID NO: 2473 - DNA, 675 bp, Homo sapiens; identical to SEQ ID NO: 401
  chr4:154709829-154710504
  hyper

SEQ ID NO: 2474 - DNA, 66 bp, Homo sapiens
  chr4:154710734-154710800
  hyper
ccctgtgatggagcccgggacctgcccgcccgaggccgcctcggcgaacttcgttttccctcgaat

SEQ ID NO: 2475 - DNA, 684 bp, Homo sapiens
  chr4:154712024-154712708
  hyper
ctctgagagatgctacgacttgggcctgggagtgggataagggccctctcgctttcacgcccccccaaccccccgccggccccggccaacccctaaatccccaacgccctccgctggggtcgcctcctccccgcagagccccttgttgggagttcaaggagcccgaagctggtctggctggtttgagccccgcgctgccgcacgcccggaagtggctggcggcccccgcgctccgcgcgccggctgcattgttttgggagccctcgctgcccggcttgccgccaggaggtgctgggagtcgcgcctgagtctccatccctgccgtgcgcagtgtccacctctggccagcttgtttgcccggcccgcggcgtcccctgcggcccatcgctgctcctcccggaacccacgccacttagtctggtcccgaccctgcactcgctgctgctgcctttcccacctcaagtcgctctccccactcccttctgcttttgggctaagaccggtccaattgatcactggggaacagggcaataacctcccgcggaggctgggacgcgggcacggagctctgcccatatgagcagcgcagggatgggacactgggtgcccatcccagcgcgcctccccagactggtccctgggatgctcacacgtggcgcggcaccgcggcggcgccttcacgaa

SEQ ID NO: 2476 - DNA, 104 bp, Homo sapiens
  chr4:155412085-155412189
  hyper
aagctgtagtggtcccgccgctcgcggtccaggcgccgcgcagtgcggatgatgccggtgtccgggtgcacgtggaagtcgtccagcagcggggagtcatcgga

SEQ ID NO: 2477 - DNA, 149 bp, Homo sapiens; identical to SEQ ID NO: 402
  chr4:155663475-155663624
  hyper

SEQ ID NO: 2478 - DNA, 480 bp, Homo sapiens
  chr4:156129606-156130086
  hyper
gcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggac

SEQ ID NO: 2479 - DNA, 98 bp, Homo sapiens
  chr4:164265532-164265630
  hyper
gggggatggacaaagcgctgcccccggctggacgcgctctggctgcagcccggctggcatccggagctgggaacagcagcccgcggggtgcccgggtc

SEQ ID NO: 2480 - DNA, 95 bp, Homo sapiens
  chr4:165305095-165305190
  hyper
atcctttgtcagttgcgggtggagcgctcctccccagctagcggacgagcagccgggtggcaggcagcccggctctggctcggctccccagtcct

SEQ ID NO: 2481 - DNA, 98 bp, Homo sapiens
  chr4:172733771-172733869
  hyper
aggttcctgagtgtgcggtcaggggcgttggtgcattgatacgttaggcggagggaggagtaccatctgccagagtcttatctcgagtcccacgtttt

SEQ ID NO: 2482 - DNA, 88 bp, Homo sapiens; identical to SEQ ID NO: 403
  chr4:172734188-172734276
  hyper

SEQ ID NO: 2483 - DNA, 115 bp, Homo sapiens; identical to SEQ ID NO: 404
  chr4:172734277-172734392
  hyper

SEQ ID NO: 2484 - DNA, 14 bp, Homo sapiens
  chr4:172734591-172734605
  hyper
ggggagtggggcgc

SEQ ID NO: 2485 - DNA, 244 bp, Homo sapiens; identical to SEQ ID NO: 406
  chr4:174430310-174430554
  hyper

SEQ ID NO: 2486 - DNA, 279 bp, Homo sapiens; identical to SEQ ID NO: 407
  chr4:174430793-174431072
  hyper

SEQ ID NO: 2487 - DNA, 299 bp, Homo sapiens
  chr4:174439888-174440187
  hyper
cctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggc

SEQ ID NO: 2488 - DNA, 383 bp, Homo sapiens
  chr4:174443551-174443934
  hyper
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtcc

SEQ ID NO: 2489 - DNA, 360 bp, Homo sapiens
  chr4:174449950-174450310
  hyper
cctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccat

SEQ ID NO: 2490 - DNA, 162 bp, Homo sapiens
  chr4:174450565-174450727
  hyper
ggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctc

SEQ ID NO: 2491 - DNA, 173 bp, Homo sapiens
  chr4:174450751-174450924
  hyper
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcg

SEQ ID NO: 2492 - DNA, 243 bp, Homo sapiens; identical to SEQ ID NO: 408
  chr4:174451855-174452098
  hyper

SEQ ID NO: 2493 - DNA, 435 bp, Homo sapiens
  chr4:175135253-175135688
  hyper
ctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgg

SEQ ID NO: 2494 - DNA, 387 bp, Homo sapiens
  chr4:175750264-175750651
  hyper
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccct

SEQ ID NO: 2495 - DNA, 124 bp, Homo sapiens
  chr4:176987050-176987174
  hyper
gcggagcacgcttcccgcccctcggagcccgcgggcccggccgccccgcccccgggcgccctgagcgagcaggcggggagggcggggagggtccgcgcgttggtggtgctcgcctcgcagctgc

SEQ ID NO: 2496 - DNA, 5 bp, Homo sapiens
  chr4:176987175-176987180
  hyper
cccgc

SEQ ID NO: 2497 - DNA, 107 bp, Homo sapiens
  chr4:176987206-176987313
  hyper
cgctgcagccgcctcctcctccaggtaagaagccggtggggccgcagagataccaaggcaagctcaggattgatgtgggtgatgctggaactgtcgcggcgtcatgc

SEQ ID NO: 2498 - DNA, 13 bp, Homo sapiens
  chr4:176987314-176987327
  hyper
agaggggctctga

SEQ ID NO: 2499 - DNA, 315 bp, Homo sapiens
  chr4:185941868-185942183
  hyper
ccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagg

SEQ ID NO: 2500 - DNA, 836 bp, Homo sapiens; identical to SEQ ID NO: 409
  chr5:1294607-1295443
  hyper

SEQ ID NO: 2501 - DNA, 75 bp, Homo sapiens; identical to SEQ ID NO: 410
  chr5:1295604-1295679
  hyper

SEQ ID NO: 2502 - DNA, 126 bp, Homo sapiens
  chr5:1446236-1446362
  hyper
cgcactcgcctaagaaaaccatttcccgggacgggcctggaaagccctggcggttggtatccggctccagggccgaatggactccgaggctttccttccgagatgcccgggcgggatttcttccat

SEQ ID NO: 2503 - DNA, 517 bp, Homo sapiens; identical to SEQ ID NO: 411
  chr5:1875025-1875542
  hyper

SEQ ID NO: 2504 - DNA, 478 bp, Homo sapiens; identical to SEQ ID NO: 412
  chr5:1875829-1876307
  hyper

SEQ ID NO: 2505 - DNA, 223 bp, Homo sapiens; identical to SEQ ID NO: 413
  chr5:1876637-1876860
  hyper

SEQ ID NO: 2506 - DNA, 28 bp, Homo sapiens
  chr5:1877194-1877222
  hyper
cgatgggctcccacgcccccccccggga

SEQ ID NO: 2507 - DNA, 15 bp, Homo sapiens
  chr5:1878014-1878029
  hyper
ctcagtgaaaagagt

SEQ ID NO: 2508 - DNA, 354 bp, Homo sapiens
  chr5:1878223-1878577
  hyper
cgagcgtcccagaggcccggggtccaggagggcgcccttggcggtggcccaggcctggttcaaagtgctgtgcctgaggatggggtcgtggaagaccccgtccacccagtttctgagactggttaccggggagtcctggtgcctgtccagggcgccagagtggggaagggccacagacggggacgtggcgggcgcggaggacacagccgcaggggccgcgggaccttggcgcttgagcatgcacgacggaaactcagtctggctcagggaggtggcggcggcggcggcggcggtggctgtgtgggccagggaccagatgcgcggcttagcctccaggcctgccgacgcccccgc

SEQ ID NO: 2509 - DNA, 43 bp, Homo sapiens
  chr5:1878830-1878873
  hyper
ggcggctctgcttccagcgggtcgaagtcgtccaagtcactaa

SEQ ID NO: 2510 - DNA, 503 bp, Homo sapiens
  chr5:1882419-1882922
  hyper
cgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaac

SEQ ID NO: 2511 - DNA, 187 bp, Homo sapiens; identical to SEQ ID NO: 414
  chr5:1883430-1883617
  hyper

SEQ ID NO: 2512 - DNA, 347 bp, Homo sapiens; identical to SEQ ID NO: 415
  chr5:1883879-1884226
  hyper

SEQ ID NO: 2513 - DNA, 174 bp, Homo sapiens; identical to SEQ ID NO: 416
  chr5:1884557-1884731
  hyper

SEQ ID NO: 2514 - DNA, 67 bp, Homo sapiens; identical to SEQ ID NO: 417
  chr5:1885314-1885381
  hyper

SEQ ID NO: 2515 - DNA, 103 bp, Homo sapiens; identical to SEQ ID NO: 418
  chr5:1886739-1886842
  hyper

SEQ ID NO: 2516 - DNA, 149 bp, Homo sapiens; identical to SEQ ID NO: 419
  chr5:1886997-1887146
  hyper

SEQ ID NO: 2517 - DNA, 36 bp, Homo sapiens; identical to SEQ ID NO: 420
  chr5:1887546-1887582
  hyper

SEQ ID NO: 2518 - DNA, 101 bp, Homo sapiens; identical to SEQ ID NO: 421
  chr5:1887655-1887756
  hyper

SEQ ID NO: 2519 - DNA, 31 bp, Homo sapiens; identical to SEQ ID NO: 422
  chr5:1930974-1931005
  hyper

SEQ ID NO: 2520 - DNA, 223 bp, Homo sapiens; identical to SEQ ID NO: 423
  chr5:1931064-1931287
  hyper

SEQ ID NO: 2521 - DNA, 133 bp, Homo sapiens; identical to SEQ ID NO: 424
  chr5:1931444-1931577
  hyper

SEQ ID NO: 2522 - DNA, 349 bp, Homo sapiens; identical to SEQ ID NO: 425
  chr5:1931617-1931966
  hyper

SEQ ID NO: 2523 - DNA, 424 bp, Homo sapiens
  chr5:2038439-2038863
  hyper
cggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacc

SEQ ID NO: 2524 - DNA, 160 bp, Homo sapiens
  chr5:2738820-2738980
  hyper
ccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagcca

SEQ ID NO: 2525 - DNA, 43 bp, Homo sapiens
  chr5:2743617-2743660
  hyper
gtcgcggatccaccacgcgggcgccgggccgcggagccgggag

SEQ ID NO: 2526 - DNA, 46 bp, Homo sapiens
  chr5:2743698-2743744
  hyper
cgccccaaagcccatctgctcctggtcgccccgttttgccgacgtc

SEQ ID NO: 2527 - DNA, 83 bp, Homo sapiens
  chr5:2751854-2751937
  hyper
gcgctcatctgcatattcgggggcccgcccctcccctgctccgcccgctgcagcctccgggccgcggccgggggaggggcaga

SEQ ID NO: 2528 - DNA, 326 bp, Homo sapiens
  chr5:2755916-2756242
  hyper
gatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttct

SEQ ID NO: 2529 - DNA, 253 bp, Homo sapiens; identical to SEQ ID NO: 426
  chr5:3590405-3590658
  hyper

SEQ ID NO: 2530 - DNA, 844 bp, Homo sapiens; identical to SEQ ID NO: 427
  chr5:6448738-6449582
  hyper

SEQ ID NO: 2531 - DNA, 101 bp, Homo sapiens
  chr5:7395293-7395394
  hyper
gtgactgaagctgagcgtgcagggcgcaacggacgctgcccccgcgaggccgtggcgggggctcccagtgcagtcactgccgcttcacttccacatggtgc

SEQ ID NO: 2532 - DNA, 113 bp, Homo sapiens
  chr5:7395433-7395546
  hyper
cgccctcgcagggagccccggccctctcaagagggtggagaggatgggggagccctcaaccctgctacgctgaggggaagaagggctggacggcaaaccggtgcccaccgcgg

SEQ ID NO: 2533 - DNA, 496 bp, Homo sapiens
  chr5:10333618-10334114
  hyper
tgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcagga

SEQ ID NO: 2534 - DNA, 31 bp, Homo sapiens; identical to SEQ ID NO: 428
  chr5:10564628-10564659
  hyper

SEQ ID NO: 2535 - DNA, 428 bp, Homo sapiens; identical to SEQ ID NO: 429
  chr5:10564800-10565228
  hyper

SEQ ID NO: 2536 - DNA, 1 bp, Homo sapiens
  chr5:10565262-10565263
  hyper
c

SEQ ID NO: 2537 - DNA, 358 bp, Homo sapiens; identical to SEQ ID NO: 431
  chr5:10565264-10565622
  hyper

SEQ ID NO: 2538 - DNA, 88 bp, Homo sapiens
  chr5:11904455-11904543
  hyper
cggcgcgcggcagcctcagcctccacctaaacctcggcggccggcccgggcgcccggctagtgagggagcgtccgccccgccgccgaa

SEQ ID NO: 2539 - DNA, 28 bp, Homo sapiens
  chr5:16179554-16179582
  hyper
cggggaccggggccggctctcccggcgg

SEQ ID NO: 2540 - DNA, 139 bp, Homo sapiens
  chr5:16180182-16180321
  hyper
cgtgagctgggaagtagggggcaggggagaggccgcgggtccagaaaccgttactggatgggccggtgggatgtggcgcgggccgggtggggcgcgacagtctgagccgagacccgcgtgggcttaagggtgcgcgagg

SEQ ID NO: 2541 - DNA, 53 bp, Homo sapiens
  chr5:16180371-16180424
  hyper
cgcgggacccgggactgtaaccgccacttccaggccctcgctccccgcgcttg

SEQ ID NO: 2542 - DNA, 121 bp, Homo sapiens
  chr5:22853104-22853225
  hyper
gcatgcaccctgaagcgatcacacacacgcggtgcaatcccaatcaaaaacggaagccttacctgatggcagaaaaggcagctgcaggagcagcagcaccgacggccgcagcagggtgcca

SEQ ID NO: 2543 - DNA, 159 bp, Homo sapiens
  chr5:31639686-31639845
  hyper
ggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaaga

SEQ ID NO: 2544 - DNA, 99 bp, Homo sapiens
  chr5:32711765-32711864
  hyper
aagcgcccaagggggcgcagggaccttggagagaagagtggggaggaaagaggaagggtgggtggggggcagagggcgagtcggcggcggcgagggcaa

SEQ ID NO: 2545 - DNA, 25 bp, Homo sapiens
  chr5:32712077-32712102
  hyper
ttgttttcactcacccgggtgcggc

SEQ ID NO: 2546 - DNA, 563 bp, Homo sapiens
  chr5:32712289-32712852
  hyper
cgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgggtgcgcgcgggcactcgttcaggtatgcgccgtgtggctgcgacaacctttgacgaccgcccatcgcggtgtacgtagagggtcccag

SEQ ID NO: 2547 - DNA, 1728 bp, Homo sapiens
  chr5:37836649-37838377
  hyper
agctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagaga

SEQ ID NO: 2548 - DNA, 285 bp, Homo sapiens
  chr5:37838600-37838885
  hyper
agttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacag

SEQ ID NO: 2549 - DNA, 268 bp, Homo sapiens
  chr5:37839807-37840075
  hyper
cgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatcc

SEQ ID NO: 2550 - DNA, 144 bp, Homo sapiens
  chr5:37840076-37840220
  hyper
aacgagacaccacgtcaaccggcgcggggagtcccgtgaagacatgagggcgccaggagcgcaggctggtcttctagagcccgggctgggggtccggggtccggggtgggggaggggaggcgcggggccccgggagggaggggt

SEQ ID NO: 2551 - DNA, 96 bp, Homo sapiens
  chr5:37840267-37840363
  hyper
cgaggaggccctggagttcccgaggcggggggccggggtgcgagtgggcgacgcgaggcgcccctccctgggctgcagggagagcgctgagagcgc

SEQ ID NO: 2552 - DNA, 187 bp, Homo sapiens
  chr5:37840529-37840716
  hyper
ggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccagg

SEQ ID NO: 2553 - DNA, 67 bp, Homo sapiens
  chr5:38257842-38257909
  hyper
gccaggaccccgccccggccccctgccccaggcccagctgggcgccgcccaggggcttttctcggtc

SEQ ID NO: 2554 - DNA, 15 bp, Homo sapiens
  chr5:38257944-38257959
  hyper
cgccaggcttaactt

SEQ ID NO: 2555 - DNA, 207 bp, Homo sapiens; identical to SEQ ID NO: 432
  chr5:42951105-42951312
  hyper

SEQ ID NO: 2556 - DNA, 693 bp, Homo sapiens; identical to SEQ ID NO: 433
  chr5:42951419-42952112
  hyper

SEQ ID NO: 2557 - DNA, 457 bp, Homo sapiens; identical to SEQ ID NO: 434
  chr5:42991785-42992242
  hyper

SEQ ID NO: 2558 - DNA, 180 bp, Homo sapiens; identical to SEQ ID NO: 435
  chr5:42992375-42992555
  hyper

SEQ ID NO: 2559 - DNA, 42 bp, Homo sapiens; identical to SEQ ID NO: 436
  chr5:42992556-42992598
  hyper

SEQ ID NO: 2560 - DNA, 239 bp, Homo sapiens; identical to SEQ ID NO: 437
  chr5:42992782-42993021
  hyper

SEQ ID NO: 2561 - DNA, 240 bp, Homo sapiens; identical to SEQ ID NO: 438
  chr5:42993321-42993561
  hyper

SEQ ID NO: 2562 - DNA, 276 bp, Homo sapiens; identical to SEQ ID NO: 439
  chr5:42993861-42994137
  hyper

SEQ ID NO: 2563 - DNA, 224 bp, Homo sapiens
  chr5:43017953-43018177
  hyper
gcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccag

SEQ ID NO: 2564 - DNA, 325 bp, Homo sapiens
  chr5:43018326-43018651
  hyper
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcg

SEQ ID NO: 2565 - DNA, 156 bp, Homo sapiens
  chr5:43019191-43019347
  hyper
gcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 2566 - DNA, 157 bp, Homo sapiens; identical to SEQ ID NO: 440
  chr5:50263484-50263641
  hyper

SEQ ID NO: 2567 - DNA, 142 bp, Homo sapiens
  chr5:50264500-50264642
  hyper
gaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcagg

SEQ ID NO: 2568 - DNA, 347 bp, Homo sapiens; identical to SEQ ID NO: 441
  chr5:54516334-54516681
  hyper

SEQ ID NO: 2569 - DNA, 96 bp, Homo sapiens; identical to SEQ ID NO: 442
  chr5:54516831-54516927
  hyper

SEQ ID NO: 2570 - DNA, 156 bp, Homo sapiens; identical to SEQ ID NO: 443
  chr5:54519133-54519289
  hyper

SEQ ID NO: 2571 - DNA, 166 bp, Homo sapiens
  chr5:59189863-59190029
  hyper
ccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctcca

SEQ ID NO: 2572 - DNA, 80 bp, Homo sapiens; identical to SEQ ID NO: 444
  chr5:63255163-63255243
  hyper

SEQ ID NO: 2573 - DNA, 395 bp, Homo sapiens
  chr5:63801877-63802272
  hyper
acaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 2574 - DNA, 32 bp, Homo sapiens
  chr5:63802273-63802305
  hyper
cttccccggctctccttcaagctgaaggttac

SEQ ID NO: 2575 - DNA, 166 bp, Homo sapiens
  chr5:63802339-63802505
  hyper
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcc

SEQ ID NO: 2576 - DNA, 194 bp, Homo sapiens
  chr5:71014720-71014914
  hyper
ctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatct

SEQ ID NO: 2577 - DNA, 481 bp, Homo sapiens; identical to SEQ ID NO: 445
  chr5:72529345-72529826
  hyper

SEQ ID NO: 2578 - DNA, 374 bp, Homo sapiens; identical to SEQ ID NO: 446
  chr5:72529889-72530263
  hyper

SEQ ID NO: 2579 - DNA, 35 bp, Homo sapiens; identical to SEQ ID NO: 447
  chr5:72594802-72594837
  hyper

SEQ ID NO: 2580 - DNA, 71 bp, Homo sapiens; identical to SEQ ID NO: 448
  chr5:72594867-72594938
  hyper

SEQ ID NO: 2581 - DNA, 383 bp, Homo sapiens; identical to SEQ ID NO: 449
  chr5:72599059-72599442
  hyper

SEQ ID NO: 2582 - DNA, 371 bp, Homo sapiens; identical to SEQ ID NO: 450
  chr5:72599462-72599833
  hyper

SEQ ID NO: 2583 - DNA, 126 bp, Homo sapiens
  chr5:75380067-75380193
  hyper
caggcgaagcagacccgaggctgtgaagctcagaggggagagggaccaatcgcagtaaataagctaccgaggtaatcttagatggcgatgagggcagcaaaagccatcagccgaccctctgaccct

SEQ ID NO: 2584 - DNA, 452 bp, Homo sapiens
  chr5:75380422-75380874
  hyper
gggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcc

SEQ ID NO: 2585 - DNA, 92 bp, Homo sapiens; identical to SEQ ID NO: 451
  chr5:76249579-76249671
  hyper

SEQ ID NO: 2586 - DNA, 212 bp, Homo sapiens; identical to SEQ ID NO: 452
  chr5:76249695-76249907
  hyper

SEQ ID NO: 2587 - DNA, 174 bp, Homo sapiens; identical to SEQ ID NO: 453
  chr5:76249944-76250118
  hyper

SEQ ID NO: 2588 - DNA, 345 bp, Homo sapiens; identical to SEQ ID NO: 454
  chr5:76923679-76924024
  hyper

SEQ ID NO: 2589 - DNA, 214 bp, Homo sapiens; identical to SEQ ID NO: 455
  chr5:76924086-76924300
  hyper

SEQ ID NO: 2590 - DNA, 262 bp, Homo sapiens
  chr5:76928678-76928940
  hyper
caattgagctgttagcggtcttaggcggagagcatctctcaggaggaaaggaaggcacagcgagaagacctaaggccgaaagtcgctgtgcagcacccacccaaggctggactcgggggaggtagacgggacggtgtctgtgactaaacggttcccacaccttacacgccgcaccgggattatgttttgaaaggtgtcttataaaatcaagaccggttcctaacaacctgcaagtgccagtgaatcccgaaatgtttgtttg

SEQ ID NO: 2591 - DNA, 984 bp, Homo sapiens
  chr5:76932282-76933266
  hyper
tatttgtcaataatgcgagcaggagttgaggtgtgcgctcggctgggccgcccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaaagcagcccaggatctcgacaggggaagggaagaccctgctccctttgcccaaatcctcccgccctgtccttgccttctgtcccagatcccaagcccctcgtacctgcactcgggactcggtcagcccgatacgcagtgccagctcctcacgcataaagatgtcggggtagtgagtcttggcgaagctcctctccaactcgttgagctgtgcgggggtgaagcgcgtccggtggcgcttctgcttctgttggccctgctgctggccggcttggctggggttcgggccgccctggggcccgggctgcttgtccgggtctttggcgctcaccgccagcgaggccggagtagagcccactgtggtgatgtcctccccgggcagcagagtggctccctccactgggtcagagttgggcgccaggtcccccggatggcccccggggtcggagccccccacgcccagcctacacttcaccgcctcccggtggcccagaagctcggcggcatctttcatacctgaggaggcaaggggatcgcggtcactactttcttggcgatgccaggaggggctgtcttccccgcgcagccttccttcaacccgtcctcggccccctccgcacccgcgcttgtcctaaggaagaaactcccagggtattcagctgggttccccagaatttggacagccgggttggaataatatctcccggccccttgccctcgccgcagc

SEQ ID NO: 2592 - DNA, 323 bp, Homo sapiens; identical to SEQ ID NO: 456
  chr5:76934331-76934654
  hyper

SEQ ID NO: 2593 - DNA, 194 bp, Homo sapiens; identical to SEQ ID NO: 457
  chr5:76934676-76934870
  hyper

SEQ ID NO: 2594 - DNA, 602 bp, Homo sapiens; identical to SEQ ID NO: 458
  chr5:76936119-76936721
  hyper

SEQ ID NO: 2595 - DNA, 182 bp, Homo sapiens; identical to SEQ ID NO: 459
  chr5:77140529-77140711
  hyper

SEQ ID NO: 2596 - DNA, 101 bp, Homo sapiens; identical to SEQ ID NO: 460
  chr5:77147549-77147650
  hyper

SEQ ID NO: 2597 - DNA, 260 bp, Homo sapiens; identical to SEQ ID NO: 461
  chr5:77147872-77148132
  hyper

SEQ ID NO: 2598 - DNA, 280 bp, Homo sapiens; identical to SEQ ID NO: 462
  chr5:77148393-77148673
  hyper

SEQ ID NO: 2599 - DNA, 367 bp, Homo sapiens; identical to SEQ ID NO: 463
  chr5:77268367-77268734
  hyper

SEQ ID NO: 2600 - DNA, 227 bp, Homo sapiens; identical to SEQ ID NO: 464
  chr5:77268735-77268962
  hyper

SEQ ID NO: 2601 - DNA, 583 bp, Homo sapiens
  chr5:79864862-79865445
  hyper
acccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 2602 - DNA, 71 bp, Homo sapiens
  chr5:79865522-79865593
  hyper
cgcatcctcctcgacaccccgcggccgggcagccctcgccggttcccgccgctcggcgaggctgagaagga

SEQ ID NO: 2603 - DNA, 315 bp, Homo sapiens
  chr5:79866099-79866414
  hyper
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctc

SEQ ID NO: 2604 - DNA, 105 bp, Homo sapiens
  chr5:80689690-80689795
  hyper
cagggttcagctctccgcaagtaccttcctcgccttcctaccccccccagcccccagccgccgccgctcccgcagccccggtcccgcgcctccccgcagccccgg

SEQ ID NO: 2605 - DNA, 364 bp, Homo sapiens; identical to SEQ ID NO: 465
  chr5:82767429-82767793
  hyper

SEQ ID NO: 2606 - DNA, 63 bp, Homo sapiens; identical to SEQ ID NO: 466
  chr5:87955602-87955665
  hyper

SEQ ID NO: 2607 - DNA, 495 bp, Homo sapiens; identical to SEQ ID NO: 467
  chr5:87956168-87956663
  hyper

SEQ ID NO: 2608 - DNA, 427 bp, Homo sapiens; identical to SEQ ID NO: 468
  chr5:87956679-87957106
  hyper

SEQ ID NO: 2609 - DNA, 304 bp, Homo sapiens; identical to SEQ ID NO: 469
  chr5:87967773-87968077
  hyper

SEQ ID NO: 2610 - DNA, 11 bp, Homo sapiens
  chr5:87968675-87968686
  hyper
gcaccggctag

SEQ ID NO: 2611 - DNA, 86 bp, Homo sapiens; identical to SEQ ID NO: 471
  chr5:87968772-87968858
  hyper

SEQ ID NO: 2612 - DNA, 73 bp, Homo sapiens; identical to SEQ ID NO: 472
  chr5:87970041-87970114
  hyper

SEQ ID NO: 2613 - DNA, 792 bp, Homo sapiens; identical to SEQ ID NO: 473
  chr5:87970115-87970907
  hyper

SEQ ID NO: 2614 - DNA, 124 bp, Homo sapiens; identical to SEQ ID NO: 474
  chr5:88185263-88185387
  hyper

SEQ ID NO: 2615 - DNA, 399 bp, Homo sapiens; identical to SEQ ID NO: 475
  chr5:88185388-88185787
  hyper

SEQ ID NO: 2616 - DNA, 12 bp, Homo sapiens
  chr5:92940177-92940189
  hyper
ggggtgggccgg

SEQ ID NO: 2617 - DNA, 59 bp, Homo sapiens
  chr5:95769034-95769093
  hyper
acctggactaagatccgaatggtattcccggcggggcggagaagcggctaaaataagca

SEQ ID NO: 2618 - DNA, 95 bp, Homo sapiens
  chr5:100238882-100238977
  hyper
agggtcgctccgcgccgcctccctggggctcaggtttcttttcagatgagacaccttgtgcattggaggtggcggcagcttctgcagctgggttc

SEQ ID NO: 2619 - DNA, 44 bp, Homo sapiens
  chr5:100238978-100239022
  hyper
ggggcgtcactggcccttccctcttgctaggagataaacgctgc

SEQ ID NO: 2620 - DNA, 97 bp, Homo sapiens
  chr5:100239023-100239120
  hyper
caaagccaatcaccaggctgagggggcggaggctgcttggagagtaacgtccccggctctgcctgctctgtgccgggagaggaagctcacagtgcta

SEQ ID NO: 2621 - DNA, 590 bp, Homo sapiens
  chr5:100239134-100239724
  hyper
cgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 2622 - DNA, 248 bp, Homo sapiens; identical to SEQ ID NO: 476
  chr5:112629488-112629736
  hyper

SEQ ID NO: 2623 - DNA, 571 bp, Homo sapiens
  chr5:114515009-114515580
  hyper
cgttcctaaaggctccaggacaggtgtggggctgaaatcccgctcctccagcatcttcccctccctaccaaaagaaggctgctttaaatattcccggcctggagcagcagcagctaaggacctggaaagaggcccgaaaaggccagggcagggcgaacgaacgtgctgtccctatttaccggccacacgctctgactgcgggctgaccctgatcgcacacttcgagcctgttcactcgctgggcggaccctccctccacgctccgcgcccaggcaggcgaggtcacccactcgaagtcaccacgtttgagtagccctggttggtggggcagcgcccccttggccaacgccccgccctcctctccatcttccgacgctgggctctcgcccttcggcgtccgagagcccctattgctgcccagctggccccaaaagcgtccgaaagtcccctcttggcttatttcagagatgccacgcaataaagaaaaggcggctactttgcattccgcagctgctgggacgcccgggctgcgagcgcggctcctggattccagcctcccgcccttcccagg

SEQ ID NO: 2624 - DNA, 61 bp, Homo sapiens
  chr5:114515610-114515671
  hyper
cgggccaggtagtgccggagtcgggggcccaggccgcggcgccccgcgcctcatcacttac

SEQ ID NO: 2625 - DNA, 173 bp, Homo sapiens; identical to SEQ ID NO: 477
  chr5:115151185-115151358
  hyper

SEQ ID NO: 2626 - DNA, 736 bp, Homo sapiens; identical to SEQ ID NO: 478
  chr5:115151649-115152385
  hyper

SEQ ID NO: 2627 - DNA, 61 bp, Homo sapiens; identical to SEQ ID NO: 479
  chr5:115152616-115152677
  hyper

SEQ ID NO: 2628 - DNA, 47 bp, Homo sapiens
  chr5:115297186-115297233
  hyper
agactccagatccagcgcagacgccaagaattcgctcaggggcacca

SEQ ID NO: 2629 - DNA, 312 bp, Homo sapiens
  chr5:119801156-119801468
  hyper
tttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtgg

SEQ ID NO: 2630 - DNA, 48 bp, Homo sapiens
  chr5:122423328-122423376
  hyper
tcttcggcagttctgcgagcagattaattgaaacgggcctggaacttc

SEQ ID NO: 2631 - DNA, 102 bp, Homo sapiens; identical to SEQ ID NO: 480
  chr5:127873552-127873654
  hyper

SEQ ID NO: 2632 - DNA, 295 bp, Homo sapiens
  chr5:127874183-127874478
  hyper
tggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggc

SEQ ID NO: 2633 - DNA, 238 bp, Homo sapiens
  chr5:127874705-127874943
  hyper
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtc

SEQ ID NO: 2634 - DNA, 355 bp, Homo sapiens
  chr5:128795742-128796097
  hyper
cagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 2635 - DNA, 366 bp, Homo sapiens
  chr5:128796098-128796464
  hyper
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgat

SEQ ID NO: 2636 - DNA, 667 bp, Homo sapiens
  chr5:134374791-134375458
  hyper
cgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttc

SEQ ID NO: 2637 - DNA, 112 bp, Homo sapiens; identical to SEQ ID NO: 481
  chr5:134385952-134386064
  hyper

SEQ ID NO: 2638 - DNA, 512 bp, Homo sapiens; identical to SEQ ID NO: 482
  chr5:134879478-134879990
  hyper

SEQ ID NO: 2639 - DNA, 123 bp, Homo sapiens; identical to SEQ ID NO: 483
  chr5:135265737-135265860
  hyper

SEQ ID NO: 2640 - DNA, 12 bp, Homo sapiens
  chr5:135265919-135265931
  hyper
cgccaggtgggc

SEQ ID NO: 2641 - DNA, 197 bp, Homo sapiens; identical to SEQ ID NO: 485
  chr5:135265932-135266129
  hyper

SEQ ID NO: 2642 - DNA, 110 bp, Homo sapiens; identical to SEQ ID NO: 486
  chr5:135266577-135266687
  hyper

SEQ ID NO: 2643 - DNA, 18 bp, Homo sapiens
  chr5:136834033-136834051
  hyper
cccagggccgggtggcgc

SEQ ID NO: 2644 - DNA, 108 bp, Homo sapiens
  chr5:136834289-136834397
  hyper
cggccgcgagccccgggcacccaggcgtcccagcgccccagcccggaggcggggaccccgcggcgggcacgggcagcgctcgcgcacctggggcgcctgtcgcgcctc

SEQ ID NO: 2645 - DNA, 159 bp, Homo sapiens
  chr5:139227762-139227921
  hyper
cgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactc

SEQ ID NO: 2646 - DNA, 52 bp, Homo sapiens
  chr5:140187094-140187146
  hyper
tgatcgtagacaggccgctgcaggttttccatgtggacgtggaggtgaggga

SEQ ID NO: 2647 - DNA, 42 bp, Homo sapiens
  chr5:140604459-140604501
  hyper
cgagaacaacagccccgccctgcacatcggcagcgtcagcgc

SEQ ID NO: 2648 - DNA, 134 bp, Homo sapiens
  chr5:140797076-140797210
  hyper
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctc

SEQ ID NO: 2649 - DNA, 228 bp, Homo sapiens; identical to SEQ ID NO: 487
  chr5:140801034-140801262
  hyper

SEQ ID NO: 2650 - DNA, 861 bp, Homo sapiens; identical to SEQ ID NO: 488
  chr5:140855598-140856459
  hyper

SEQ ID NO: 2651 - DNA, 87 bp, Homo sapiens; identical to SEQ ID NO: 489
  chr5:140856546-140856633
  hyper

SEQ ID NO: 2652 - DNA, 347 bp, Homo sapiens
  chr5:141262718-141263065
  hyper
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtct

SEQ ID NO: 2653 - DNA, 25 bp, Homo sapiens
  chr5:141931330-141931355
  hyper
ctcacttctccttctcgcccttaat

SEQ ID NO: 2654 - DNA, 60 bp, Homo sapiens
  chr5:141931424-141931484
  hyper
cgccggcgccccgggtgggctcccggagcgcgcgggcctgtgacccggaggtcagagatg

SEQ ID NO: 2655 - DNA, 71 bp, Homo sapiens
  chr5:145713641-145713712
  hyper
cgtgccgagccctcacggacgctcggcctctggcccctgaatccctctgggcgtctcggatcctctgagcc

SEQ ID NO: 2656 - DNA, 203 bp, Homo sapiens
  chr5:145716994-145717197
  hyper
cggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 2657 - DNA, 156 bp, Homo sapiens
  chr5:145717248-145717404
  hyper
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacc

SEQ ID NO: 2658 - DNA, 42 bp, Homo sapiens
  chr5:145719895-145719937
  hyper
gaagatcgcggccatcgctgagaaactggaccttaaaaagaa

SEQ ID NO: 2659 - DNA, 280 bp, Homo sapiens
  chr5:145720018-145720298
  hyper
cgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacg

SEQ ID NO: 2660 - DNA, 92 bp, Homo sapiens; identical to SEQ ID NO: 490
  chr5:145722375-145722467
  hyper

SEQ ID NO: 2661 - DNA, 467 bp, Homo sapiens; identical to SEQ ID NO: 491
  chr5:145722560-145723027
  hyper

SEQ ID NO: 2662 - DNA, 151 bp, Homo sapiens; identical to SEQ ID NO: 492
  chr5:145725693-145725844
  hyper

SEQ ID NO: 2663 - DNA, 566 bp, Homo sapiens
  chr5:150051101-150051667
  hyper
cctggtcccctgccccgctgagcttctctgcggtttattctaccccctcgttcccagatgctggccggaagcgccaggaggaaggtgactggaacagcggagtcggggacggtgagcgtggaggggagctccctggaagggaagctgggggaaggggagcgcggctgggggcgggaggtcgtcggtggcctctgagaacccgcccctgtgcccaggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggtgagtggcctcctcgggtcccgggaccagggctggggggcctgaagcatgggtgtgctccccatggggcaggaagagcacccagaaggctagtccgcccccttccccaacacacacgcgcacgcgcgcactcccctcgccagaccacgagccggaggggcgccgcgccccaggtcacacagcgagtcagccaaggc

SEQ ID NO: 2664 - DNA, 97 bp, Homo sapiens
  chr5:152870193-152870290
  hyper
cagctagcatgaggacgggcttcttttcccgtgctcagttaatctggctgtcagttggtgttaacgctgcagtttaagtgttcggattccaagggaa

SEQ ID NO: 2665 - DNA, 59 bp, Homo sapiens
  chr5:153852733-153852792
  hyper
agctagaccagggtgcgcattcttcccgtgcctaggatacttcacggtgctaaaaatag

SEQ ID NO: 2666 - DNA, 27 bp, Homo sapiens
  chr5:153853277-153853304
  hyper
gcccgcgtggcctctcggcccctgcta

SEQ ID NO: 2667 - DNA, 133 bp, Homo sapiens
  chr5:153853386-153853519
  hyper
cgaggccctgccccggagctgcctgaggtctcctttcttgttcccaagccgagcgctcaggctccaggtgcgcagagcgaaagttccaagacagcctcacgggtctcccctcctccttcgcagtgagcgccgc

SEQ ID NO: 2668 - DNA, 32 bp, Homo sapiens
  chr5:153855232-153855264
  hyper
gctcagcagaagctccgcgggatgcgtagcac

SEQ ID NO: 2669 - DNA, 375 bp, Homo sapiens; identical to SEQ ID NO: 493
  chr5:158527442-158527817
  hyper

SEQ ID NO: 2670 - DNA, 251 bp, Homo sapiens; identical to SEQ ID NO: 494
  chr5:158527818-158528069
  hyper

SEQ ID NO: 2671 - DNA, 28 bp, Homo sapiens
  chr5:159399072-159399100
  hyper
tcgcctgggcggctgcgcctacacctac

SEQ ID NO: 2672 - DNA, 210 bp, Homo sapiens
  chr5:160975724-160975934
  hyper
ggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 2673 - DNA, 15 bp, Homo sapiens
  chr5:160975955-160975970
  hyper
cggaagtagctccac

SEQ ID NO: 2674 - DNA, 177 bp, Homo sapiens
  chr5:167956090-167956267
  hyper
tggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttc

SEQ ID NO: 2675 - DNA, 31 bp, Homo sapiens
  chr5:167956413-167956444
  hyper
cggacaaccgccgggacgaccacccagagcc

SEQ ID NO: 2676 - DNA, 235 bp, Homo sapiens
  chr5:169064295-169064530
  hyper
ttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 2677 - DNA, 274 bp, Homo sapiens
  chr5:169064531-169064805
  hyper
aggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcc

SEQ ID NO: 2678 - DNA, 378 bp, Homo sapiens
  chr5:170108034-170108412
  hyper
ccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagt

SEQ ID NO: 2679 - DNA, 100 bp, Homo sapiens; identical to SEQ ID NO: 495
  chr5:170735131-170735231
  hyper

SEQ ID NO: 2680 - DNA, 116 bp, Homo sapiens; identical to SEQ ID NO: 496
  chr5:170736715-170736831
  hyper

SEQ ID NO: 2681 - DNA, 454 bp, Homo sapiens; identical to SEQ ID NO: 497
  chr5:170737281-170737735
  hyper

SEQ ID NO: 2682 - DNA, 69 bp, Homo sapiens; identical to SEQ ID NO: 498
  chr5:170737795-170737864
  hyper

SEQ ID NO: 2683 - DNA, 755 bp, Homo sapiens; identical to SEQ ID NO: 499
  chr5:170737935-170738690
  hyper

SEQ ID NO: 2684 - DNA, 1116 bp, Homo sapiens; identical to SEQ ID NO: 500
  chr5:170738823-170739939
  hyper

SEQ ID NO: 2685 - DNA, 23 bp, Homo sapiens
  chr5:170740455-170740478
  hyper
aaggcaaaacactttcggggccg

SEQ ID NO: 2686 - DNA, 99 bp, Homo sapiens
  chr5:170740574-170740673
  hyper
cgtgctccgagccttcgttctatgcgggctgcgggactgtattcacctgcagggctggaggaaggggagggcgcctgagaaacaccttgaacccccagc

SEQ ID NO: 2687 - DNA, 125 bp, Homo sapiens
  chr5:170740674-170740799
  hyper
ctcccgccgtcacctccacctccaagcccagctagcctgggatctgcgcctttcaggacataaagacacccagggagggactagggtgactcagaacttcgggtctcttccgtgagtgttttcct

SEQ ID NO: 2688 - DNA, 741 bp, Homo sapiens
  chr5:170741487-170742228
  hyper
ccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagc

SEQ ID NO: 2689 - DNA, 152 bp, Homo sapiens; identical to SEQ ID NO: 501
  chr5:170742448-170742600
  hyper

SEQ ID NO: 2690 - DNA, 166 bp, Homo sapiens; identical to SEQ ID NO: 502
  chr5:170742672-170742838
  hyper

SEQ ID NO: 2691 - DNA, 342 bp, Homo sapiens; identical to SEQ ID NO: 503
  chr5:170743138-170743480
  hyper

SEQ ID NO: 2692 - DNA, 482 bp, Homo sapiens; identical to SEQ ID NO: 504
  chr5:170743646-170744128
  hyper

SEQ ID NO: 2693 - DNA, 171 bp, Homo sapiens; identical to SEQ ID NO: 505
  chr5:172659855-172660026
  hyper

SEQ ID NO: 2694 - DNA, 77 bp, Homo sapiens; identical to SEQ ID NO: 506
  chr5:172660141-172660218
  hyper

SEQ ID NO: 2695 - DNA, 82 bp, Homo sapiens
  chr5:172660919-172661001
  hyper
gcgcctgcggcctcccgggaatcgcccgggctcctgccttgggctggggggtctcccagaaggcccctttctgcagcggggc

SEQ ID NO: 2696 - DNA, 20 bp, Homo sapiens
  chr5:172661126-172661146
  hyper
cgcgccggcaagttgtgctg

SEQ ID NO: 2697 - DNA, 359 bp, Homo sapiens
  chr5:172661471-172661830
  hyper
acccaggagcagagccgaagccgcccggggctttgttaggccggggggaaacgttttttggtctcttgcttctgatcctttcaatccggcatttcctctgaacctccgattggacgcggggcgcgggagcctggcgacaacaccaggcatcttacattctgaaccccccgccgcagcccagccctcggcccaagggcgcgtgtctcctcctcctggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaa

SEQ ID NO: 2698 - DNA, 149 bp, Homo sapiens
  chr5:172670933-172671082
  hyper
ccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggaca

SEQ ID NO: 2699 - DNA, 87 bp, Homo sapiens; identical to SEQ ID NO: 507
  chr5:172671395-172671482
  hyper

SEQ ID NO: 2700 - DNA, 153 bp, Homo sapiens; identical to SEQ ID NO: 508
  chr5:172671639-172671792
  hyper

SEQ ID NO: 2701 - DNA, 156 bp, Homo sapiens
  chr5:174115433-174115589
  hyper
atcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 2702 - DNA, 279 bp, Homo sapiens
  chr5:174159299-174159578
  hyper
ggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtc

SEQ ID NO: 2703 - DNA, 1140 bp, Homo sapiens
  chr5:174870738-174871878
  hyper
ttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 2704 - DNA, 241 bp, Homo sapiens
  chr5:175085074-175085315
  hyper
catccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 2705 - DNA, 79 bp, Homo sapiens
  chr5:175085524-175085603
  hyper
cgaaacagtccccgttttgtctccgggtctgggtggtggcattttctcgcggcgatgtgtctgtcggagcatggagcaa

SEQ ID NO: 2706 - DNA, 30 bp, Homo sapiens
  chr5:175223920-175223950
  hyper
cctggagctctcagccgccggcggctcttc

SEQ ID NO: 2707 - DNA, 272 bp, Homo sapiens
  chr5:176046306-176046578
  hyper
gagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagg

SEQ ID NO: 2708 - DNA, 458 bp, Homo sapiens
  chr5:176056505-176056963
  hyper
cagccccagaaaccccgccccttacccaccgacgtagaggacgccctccttggtcttctccgccgcctcggtgaccccctgcttggttttctccgcggctgccacaacgccctccttggccatggacaggcccttcatgaacacgtccatcctggcggcctggggagggcgatacacgggcaccggtgcactggccccgcactctcaccccagcccctcccgcgggacgcagatgcccccctactcccgagaccgcggcgcccttctggaccctgagccccctcccgctttccccccatcccaccccactccccagtgcgaagcctcagggccgcggagagtcctagcgtccttgaaacctggggacgcgggaggggccactgcctcggttatccgggccctgcaaactgcagccccgtcgaaccggagtgctgggttcggcgcgaatatccaggacc

SEQ ID NO: 2709 - DNA, 125 bp, Homo sapiens
  chr5:176107360-176107485
  hyper
gccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 2710 - DNA, 69 bp, Homo sapiens
  chr5:176107517-176107586
  hyper
cgcgaggattggagactggggacccggcagcagagggtccaggcagaaaagctccgtgtggcccccagg

SEQ ID NO: 2711 - DNA, 95 bp, Homo sapiens
  chr5:177411327-177411422
  hyper
actcttgtggagacccggacgtcaggcgtggcgcgttggggaagcagctccacggggacccaggaggcgccggccgggttgagccgggttggttc

SEQ ID NO: 2712 - DNA, 15 bp, Homo sapiens
  chr5:177411507-177411522
  hyper
cgcggagatgggcca

SEQ ID NO: 2713 - DNA, 303 bp, Homo sapiens; identical to SEQ ID NO: 509
  chr5:178016681-178016984
  hyper

SEQ ID NO: 2714 - DNA, 52 bp, Homo sapiens; identical to SEQ ID NO: 510
  chr5:178017519-178017571
  hyper

SEQ ID NO: 2715 - DNA, 111 bp, Homo sapiens; identical to SEQ ID NO: 511
  chr5:178017572-178017683
  hyper

SEQ ID NO: 2716 - DNA, 100 bp, Homo sapiens
  chr5:178770805-178770905
  hyper
cggctaggccggccacgtctccgacgtagagacagctcccgagcaggggctccacgcgggtggtgcccttctcgccctgccactccatagtggccccggg

SEQ ID NO: 2717 - DNA, 433 bp, Homo sapiens
  chr5:178771198-178771631
  hyper
cggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggag

SEQ ID NO: 2718 - DNA, 58 bp, Homo sapiens
  chr5:178771723-178771781
  hyper
cgaggactgggaggggtggaacagggtccctccgatctccggggattccctgcggggc

SEQ ID NO: 2719 - DNA, 78 bp, Homo sapiens
  chr5:178771782-178771860
  hyper
ccccaaccaatccttagggcccaaggctacgcgctcggcagccggctcctccggagcgtccccggacgcgagccccgg

SEQ ID NO: 2720 - DNA, 3 bp, Homo sapiens
  chr5:178771967-178771970
  hyper
cgc

SEQ ID NO: 2721 - DNA, 546 bp, Homo sapiens
  chr5:178772184-178772730
  hyper
acctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggc

SEQ ID NO: 2722 - DNA, 58 bp, Homo sapiens
  chr5:178772778-178772836
  hyper
cggcgccggccgaacgtccccacctagagagcccttggggtgccgggtcccacccatc

SEQ ID NO: 2723 - DNA, 240 bp, Homo sapiens
  chr5:178957706-178957946
  hyper
ctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 2724 - DNA, 699 bp, Homo sapiens
  chr5:179780528-179781227
  hyper
gtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcact

SEQ ID NO: 2725 - DNA, 153 bp, Homo sapiens
  chr5:180017536-180017689
  hyper
agttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 2726 - DNA, 442 bp, Homo sapiens
  chr5:180017690-180018132
  hyper
gggatgcccaggctgctcagcaggagcttcagcgggttgagggtgccgagggggttggccagggtcccggccccggcctccgccgccgactccagcgcagcgacaggctgggccacaggcttggccgagcccactaagaaagcagcagctgcaagcgaacagggaggggtcaccgcctgcgcgccggggtccccagaaggcaggtccaggacgcgcccccgcgggaggcgcccaggaaccgtcgcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcg

SEQ ID NO: 2727 - DNA, 126 bp, Homo sapiens
  chr5:180018484-180018610
  hyper
ggggaacctgcggctgcccgggcaaggccacgaggcttcttatacccggtcctcgcccctccagcgccggcctcgcccgcgctcctgagaaagccctgcccgctccgctcacggccgtgccctggc

SEQ ID NO: 2728 - DNA, 44 bp, Homo sapiens; identical to SEQ ID NO: 512
  chr5:180075814-180075858
  hyper

SEQ ID NO: 2729 - DNA, 405 bp, Homo sapiens; identical to SEQ ID NO: 513
  chr5:180076053-180076458
  hyper

SEQ ID NO: 2730 - DNA, 314 bp, Homo sapiens; identical to SEQ ID NO: 514
  chr5:180076532-180076846
  hyper

SEQ ID NO: 2731 - DNA, 153 bp, Homo sapiens
  chr5:180101015-180101168
  hyper
cgcagccccgcgcccctctggctcctgttcccgggcgcggggagaaggcggcggggcgcgcctgggcccgcgcgggtgcgaacgcgaggtctttcctgggtgctcccaggtcggaggattcccagggcgggggccatcagggtggcgaggaac

SEQ ID NO: 2732 - DNA, 135 bp, Homo sapiens
  chr5:180531170-180531305
  hyper
ccacaccctctcgtccggtctcccatgcccccttatgctaccgcgtcgggcatgaaaacttccttttctttcttctccttctttccttccttttgagacagggtcttgctctgtctccgccgctggagtgcagtc

SEQ ID NO: 2733 - DNA, 210 bp, Homo sapiens
  chr5:180600858-180601068
  hyper
cattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggcaaaccacaacaagctggcagcggtgggattcgaacccac

SEQ ID NO: 2734 - DNA, 90 bp, Homo sapiens
  chr5:180601128-180601218
  hyper
ctccgggggttcacctgcatcttttccttccttataaaacatccccagggttcccgggccaacaaggcgttggggcgaatccacagggca

SEQ ID NO: 2735 - DNA, 534 bp, Homo sapiens; identical to SEQ ID NO: 515
  chr6:391209-391743
  hyper

SEQ ID NO: 2736 - DNA, 20 bp, Homo sapiens
  chr6:391744-391764
  hyper
cactctcagtttcaccgctc

SEQ ID NO: 2737 - DNA, 135 bp, Homo sapiens; identical to SEQ ID NO: 517
  chr6:391765-391900
  hyper

SEQ ID NO: 2738 - DNA, 25 bp, Homo sapiens
  chr6:392409-392434
  hyper
gctctcccgggcctgctccggggtc

SEQ ID NO: 2739 - DNA, 372 bp, Homo sapiens; identical to SEQ ID NO: 519
  chr6:392587-392959
  hyper

SEQ ID NO: 2740 - DNA, 115 bp, Homo sapiens; identical to SEQ ID NO: 520
  chr6:393124-393239
  hyper

SEQ ID NO: 2741 - DNA, 233 bp, Homo sapiens; identical to SEQ ID NO: 521
  chr6:393240-393473
  hyper

SEQ ID NO: 2742 - DNA, 277 bp, Homo sapiens
  chr6:1378199-1378476
  hyper
catattggaggaagtcggccggcagcttcaccctcctgcgggaaaatgcaaagtccatcaccaatagtcggtctaccgcagagaagtctgcaaatcccaggggcctggaactctaaaaaggccattcaagcctcaggtggactccacgtttctccatttccctgcccttccgcttttctttccttaacaagcttcttataacatttgcgtttgatgaggttcaagaggtcacttcccctccctctccgccctcctcgctcggcggagcggccgcgtc

SEQ ID NO: 2743 - DNA, 21 bp, Homo sapiens
  chr6:1383859-1383880
  hyper
ggggcccggggcctttggcca

SEQ ID NO: 2744 - DNA, 53 bp, Homo sapiens; identical to SEQ ID NO: 522
  chr6:1384127-1384180
  hyper

SEQ ID NO: 2745 - DNA, 19 bp, Homo sapiens
  chr6:1384625-1384644
  hyper
cgagcgttgccacagccgg

SEQ ID NO: 2746 - DNA, 261 bp, Homo sapiens; identical to SEQ ID NO: 524
  chr6:1625257-1625518
  hyper

SEQ ID NO: 2747 - DNA, 260 bp, Homo sapiens; identical to SEQ ID NO: 525
  chr6:6003269-6003529
  hyper

SEQ ID NO: 2748 - DNA, 395 bp, Homo sapiens; identical to SEQ ID NO: 526
  chr6:6004349-6004744
  hyper

SEQ ID NO: 2749 - DNA, 329 bp, Homo sapiens; identical to SEQ ID NO: 527
  chr6:6004836-6005165
  hyper

SEQ ID NO: 2750 - DNA, 192 bp, Homo sapiens; identical to SEQ ID NO: 528
  chr6:6006691-6006883
  hyper

SEQ ID NO: 2751 - DNA, 352 bp, Homo sapiens
  chr6:6007318-6007670
  hyper
accttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 2752 - DNA, 102 bp, Homo sapiens
  chr6:6007671-6007773
  hyper
attaattcgaaagcgctcctcggccgcccgccccctgcgcttgcctaccctctttttctccaacccagcagctgagctctgggcgcagcctggagcgcgtga

SEQ ID NO: 2753 - DNA, 274 bp, Homo sapiens
  chr6:6007833-6008107
  hyper
cgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatt

SEQ ID NO: 2754 - DNA, 86 bp, Homo sapiens; identical to SEQ ID NO: 529
  chr6:10381507-10381593
  hyper

SEQ ID NO: 2755 - DNA, 138 bp, Homo sapiens; identical to SEQ ID NO: 530
  chr6:10381831-10381969
  hyper

SEQ ID NO: 2756 - DNA, 184 bp, Homo sapiens
  chr6:10382722-10382906
  hyper
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgt

SEQ ID NO: 2757 - DNA, 1050 bp, Homo sapiens; identical to SEQ ID NO: 531
  chr6:10390023-10391073
  hyper

SEQ ID NO: 2758 - DNA, 65 bp, Homo sapiens
  chr6:10417158-10417223
  hyper
ctgagcacaattcctcggctgaaccgggctggaggcttggcgccgccctccgtccagaaaatggt

SEQ ID NO: 2759 - DNA, 103 bp, Homo sapiens; identical to SEQ ID NO: 532
  chr6:10417427-10417530
  hyper

SEQ ID NO: 2760 - DNA, 363 bp, Homo sapiens; identical to SEQ ID NO: 533
  chr6:10419077-10419440
  hyper

SEQ ID NO: 2761 - DNA, 56 bp, Homo sapiens; identical to SEQ ID NO: 534
  chr6:10419476-10419532
  hyper

SEQ ID NO: 2762 - DNA, 96 bp, Homo sapiens; identical to SEQ ID NO: 535
  chr6:10421356-10421452
  hyper

SEQ ID NO: 2763 - DNA, 568 bp, Homo sapiens; identical to SEQ ID NO: 536
  chr6:10421548-10422116
  hyper

SEQ ID NO: 2764 - DNA, 306 bp, Homo sapiens
  chr6:10422355-10422661
  hyper
cgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcact

SEQ ID NO: 2765 - DNA, 161 bp, Homo sapiens
  chr6:10425629-10425790
  hyper
cgcgacatctcttggcggcgttgaccgtttgcccgggacactggtttagaagcacggcatagggtgtctctacatcttagaaatcaagacagcctctaggttagaataaagtttactctggactgggcataactccactccacctctgcgattcttcttct

SEQ ID NO: 2766 - DNA, 54 bp, Homo sapiens
  chr6:10425838-10425892
  hyper
cgctactttaacgtctcagtctcgttcgctaagcccatgcgcctgggacttgtt

SEQ ID NO: 2767 - DNA, 393 bp, Homo sapiens
  chr6:10426185-10426578
  hyper
ggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggct

SEQ ID NO: 2768 - DNA, 210 bp, Homo sapiens
  chr6:10881854-10882064
  hyper
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctga

SEQ ID NO: 2769 - DNA, 16 bp, Homo sapiens
  chr6:10887169-10887185
  hyper
gtaaacttcagggggc

SEQ ID NO: 2770 - DNA, 486 bp, Homo sapiens
  chr6:10887186-10887672
  hyper
gattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagcc

SEQ ID NO: 2771 - DNA, 102 bp, Homo sapiens
  chr6:19691895-19691997
  hyper
ctgagaaaatgtccccgctcggggctgctccgccatctgggccgcgggctgggcgcgcggctcccgcccccagctccttggcagaggcgccggaggaagggg

SEQ ID NO: 2772 - DNA, 44 bp, Homo sapiens
  chr6:19692142-19692186
  hyper
cgtcccgagggctctcccttttcccagagcgcataccaaaggca

SEQ ID NO: 2773 - DNA, 80 bp, Homo sapiens
  chr6:26184021-26184101
  hyper
gcatgcctgagccagcgaaatccgctcccgccccgaagaagggctccaagaaggccgtgaccaaggcgcagaagaaggac

SEQ ID NO: 2774 - DNA, 163 bp, Homo sapiens
  chr6:26188740-26188903
  hyper
attgccgagatcgcgccattgattactccagcatgggcgacacagcaagagtgaaaataaactttaatacactatcctcaccggccagtaagatatgaagccaaggcgtaataagaccatttaacttgaaaaccggagctactaaacacgtgaaactacactt

SEQ ID NO: 2775 - DNA, 436 bp, Homo sapiens
  chr6:26240682-26241118
  hyper
tttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagc

SEQ ID NO: 2776 - DNA, 41 bp, Homo sapiens
  chr6:26250098-26250139
  hyper
tacttttagtgaagacgggttttcactatgttaggcagact

SEQ ID NO: 2777 - DNA, 486 bp, Homo sapiens
  chr6:26250199-26250685
  hyper
ggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcac

SEQ ID NO: 2778 - DNA, 154 bp, Homo sapiens
  chr6:26250686-26250840
  hyper
gagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatg

SEQ ID NO: 2779 - DNA, 128 bp, Homo sapiens
  chr6:26251054-26251182
  hyper
tgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 2780 - DNA, 325 bp, Homo sapiens
  chr6:26251641-26251966
  hyper
ttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaaggcgcagaagaaggatggcaagaagc

SEQ ID NO: 2781 - DNA, 208 bp, Homo sapiens
  chr6:26271371-26271579
  hyper
tcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggt

SEQ ID NO: 2782 - DNA, 157 bp, Homo sapiens; identical to SEQ ID NO: 537
  chr6:26327825-26327982
  hyper

SEQ ID NO: 2783 - DNA, 85 bp, Homo sapiens
  chr6:26328331-26328416
  hyper
tttctataggtataacgcctgtcttcgttcgtcagagggccagtggcgcaatggataacgcgtctgactacggatcagaagattc

SEQ ID NO: 2784 - DNA, 240 bp, Homo sapiens; identical to SEQ ID NO: 538
  chr6:26501949-26502189
  hyper

SEQ ID NO: 2785 - DNA, 277 bp, Homo sapiens
  chr6:26577158-26577435
  hyper
atactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacct

SEQ ID NO: 2786 - DNA, 102 bp, Homo sapiens
  chr6:27064667-27064769
  hyper
gctggctcccaggtgcgctatccgacgcagcgagacgcggtgagcctacagaagggctgaccaggctcacctgacgccccaggtcgacagcaaaccccgtgc

SEQ ID NO: 2787 - DNA, 233 bp, Homo sapiens
  chr6:27064770-27065003
  hyper
ccccgttggcccggtcacgcccgcagcctgctcaggcgcctcctgcctcgggaccaggaagcggaagaaagggagagaccggcccggcaattacgtttctatcatgtcttgaacatttgtgtgagtcccacgaaagctaagcccgtttattccccctcgaagcgtttccactcagttcttgatcattcatgtgaaaacgagccatctccacgtctcccaaacgtcttcaaacc

SEQ ID NO: 2788 - DNA, 264 bp, Homo sapiens
  chr6:27065004-27065268
  hyper
tttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaa

SEQ ID NO: 2789 - DNA, 79 bp, Homo sapiens
  chr6:27205332-27205411
  hyper
gaaggtgagaaccctcgtggcccgtacggggatcgaacccgcgaccttggcgttattagcaccacgctctaaccaactg

SEQ ID NO: 2790 - DNA, 15 bp, Homo sapiens
  chr6:27228172-27228187
  hyper
gaagagcccacctgc

SEQ ID NO: 2791 - DNA, 170 bp, Homo sapiens; identical to SEQ ID NO: 540
  chr6:27228289-27228459
  hyper

SEQ ID NO: 2792 - DNA, 103 bp, Homo sapiens
  chr6:27247636-27247739
  hyper
ggaaagggtggctttcggcaaagtctcggcctcgccttgaccctccaggaaaaatgttcctgagcggaaagatcgttcaagttgcctgcgaaccaagtccttg

SEQ ID NO: 2793 - DNA, 153 bp, Homo sapiens
  chr6:27256079-27256232
  hyper
cctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttagg

SEQ ID NO: 2794 - DNA, 725 bp, Homo sapiens; identical to SEQ ID NO: 541
  chr6:27279795-27280520
  hyper

SEQ ID NO: 2795 - DNA, 498 bp, Homo sapiens
  chr6:27463133-27463631
  hyper
ttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaat

SEQ ID NO: 2796 - DNA, 123 bp, Homo sapiens; identical to SEQ ID NO: 542
  chr6:27512761-27512884
  hyper

SEQ ID NO: 2797 - DNA, 151 bp, Homo sapiens; identical to SEQ ID NO: 543
  chr6:27512994-27513145
  hyper

SEQ ID NO: 2798 - DNA, 138 bp, Homo sapiens
  chr6:27513349-27513487
  hyper
ctgaatgagctctttcgttcgtgagcagaggccctgacgagactgaagaccaactatttccgagcgctccactcaaccattataagttcaccccagccgtcagcgatggcgtaggtaggtagtcgtggccgagtggtt

SEQ ID NO: 2799 - DNA, 385 bp, Homo sapiens
  chr6:27533992-27534377
  hyper
ctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 2800 - DNA, 19 bp, Homo sapiens
  chr6:27835078-27835097
  hyper
ccacgtcgtagccaccggc

SEQ ID NO: 2801 - DNA, 884 bp, Homo sapiens
  chr6:27839689-27840573
  hyper
ctctcccctcggatgcggcgcgcaagctggatgtctttaggcataatagtgacgcgtttggcgtgaatggcgcacaggttggtatcctcaaatagccccaccaggtaggcctcgcaagcctcctgcagcgccatcaccgccgagctctggaagcgcagatcggtcttaaagtcctgtgcgatctcccgtaccaagcgctgaaaaggtagcttccggattagcagctcggtcgacttctggtagcggcggatctcgcgcagggccacggtgccggggcggtagcggtggggcttcttgacgccaccggtggccggagcgctcttgcgagccgccttggtggccagctgcttgcgcggcgctttgccgccggtggacttgcgagctgtttgctttgttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagtatttctcaaatttaaacgtacttaatgtttt

SEQ ID NO: 2802 - DNA, 446 bp, Homo sapiens
  chr6:28175836-28176282
  hyper
gcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaat

SEQ ID NO: 2803 - DNA, 225 bp, Homo sapiens; identical to SEQ ID NO: 544
  chr6:28367054-28367279
  hyper

SEQ ID NO: 2804 - DNA, 67 bp, Homo sapiens; identical to SEQ ID NO: 545
  chr6:28367280-28367347
  hyper

SEQ ID NO: 2805 - DNA, 81 bp, Homo sapiens; identical to SEQ ID NO: 546
  chr6:28367490-28367571
  hyper

SEQ ID NO: 2806 - DNA, 243 bp, Homo sapiens; identical to SEQ ID NO: 547
  chr6:28367572-28367815
  hyper

SEQ ID NO: 2807 - DNA, 16 bp, Homo sapiens
  chr6:28411014-28411030
  hyper
agcccttccaggctgc

SEQ ID NO: 2808 - DNA, 57 bp, Homo sapiens; identical to SEQ ID NO: 549
  chr6:28411031-28411088
  hyper

SEQ ID NO: 2809 - DNA, 241 bp, Homo sapiens; identical to SEQ ID NO: 550
  chr6:28411151-28411392
  hyper

SEQ ID NO: 2810 - DNA, 187 bp, Homo sapiens; identical to SEQ ID NO: 551
  chr6:36252984-36253171
  hyper

SEQ ID NO: 2811 - DNA, 15 bp, Homo sapiens
  chr6:41605937-41605952
  hyper
cagagagcagggagt

SEQ ID NO: 2812 - DNA, 320 bp, Homo sapiens
  chr6:41606037-41606357
  hyper
cggacagacgtgtccggctcctggctgggccaagcccggcgcgggggaggggacccgcagaggggcgactgagaaggcgaggagggggcggggagagggtgggccagggaagaggggaggggagaggcgagtaggggaggagcgaggggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatc

SEQ ID NO: 2813 - DNA, 42 bp, Homo sapiens
  chr6:41606527-41606569
  hyper
cgccctatggagcccccagcgcagccccgggcccaggtagga

SEQ ID NO: 2814 - DNA, 460 bp, Homo sapiens
  chr6:50681604-50682064
  hyper
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatc

SEQ ID NO: 2815 - DNA, 20 bp, Homo sapiens
  chr6:50682319-50682339
  hyper
tgattttgagcagcccgggc

SEQ ID NO: 2816 - DNA, 236 bp, Homo sapiens
  chr6:50682448-50682684
  hyper
cgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaaggctctctggtgaagacgctgagacc

SEQ ID NO: 2817 - DNA, 230 bp, Homo sapiens
  chr6:50682711-50682941
  hyper
cgctcgctttccttggagtgccagagaaagctcctggctccgggagagcggcgccttggttgcaaaatgacaaacctcaagtttttctgctctcccttttccccctcttccttccagatacgtcacgacggatcaaacagctaccgtttgatgcagcttggctgtctggagtcagtagccaattccactgtcgcctattcctcctcctctcctttaacttactccaccac

SEQ ID NO: 2818 - DNA, 64 bp, Homo sapiens
  chr6:50682991-50683055
  hyper
cgctccaccaccagtccttccattacgagtttcagcacagccacccggccgtcacccccgacgc

SEQ ID NO: 2819 - DNA, 304 bp, Homo sapiens; identical to SEQ ID NO: 552
  chr6:50691909-50692213
  hyper

SEQ ID NO: 2820 - DNA, 213 bp, Homo sapiens; identical to SEQ ID NO: 553
  chr6:50692299-50692512
  hyper

SEQ ID NO: 2821 - DNA, 318 bp, Homo sapiens; identical to SEQ ID NO: 554
  chr6:50791177-50791495
  hyper

SEQ ID NO: 2822 - DNA, 36 bp, Homo sapiens; identical to SEQ ID NO: 555
  chr6:50791550-50791586
  hyper

SEQ ID NO: 2823 - DNA, 216 bp, Homo sapiens; identical to SEQ ID NO: 556
  chr6:50804152-50804368
  hyper

SEQ ID NO: 2824 - DNA, 87 bp, Homo sapiens; identical to SEQ ID NO: 557
  chr6:50810627-50810714
  hyper

SEQ ID NO: 2825 - DNA, 490 bp, Homo sapiens; identical to SEQ ID NO: 558
  chr6:50813325-50813815
  hyper

SEQ ID NO: 2826 - DNA, 527 bp, Homo sapiens; identical to SEQ ID NO: 559
  chr6:56818720-56819247
  hyper

SEQ ID NO: 2827 - DNA, 83 bp, Homo sapiens
  chr6:58147428-58147511
  hyper
gaaaaccgcatctcccgaaatcccagaacgtaaacgtcgcccaggtactcgctctcttgtcattctccgggatgtaaaagact

SEQ ID NO: 2828 - DNA, 214 bp, Homo sapiens
  chr6:58147762-58147976
  hyper
acaggcccggcggcggagccctgctcccctcccttatcagtaccgcggttagtgctctgctttatggccgcagcaatctcagacactttcggagcgtgttttttttttcttgtcctttcgctccccttttcgggcgccagctttcaaaccagaccaaaggtgtgctttcccccattatctcccagccttctttccttttcgcctctactcaagg

SEQ ID NO: 2829 - DNA, 420 bp, Homo sapiens; identical to SEQ ID NO: 560
  chr6:62995455-62995875
  hyper

SEQ ID NO: 2830 - DNA, 53 bp, Homo sapiens; identical to SEQ ID NO: 561
  chr6:62996077-62996130
  hyper

SEQ ID NO: 2831 - DNA, 83 bp, Homo sapiens; identical to SEQ ID NO: 562
  chr6:62996131-62996214
  hyper

SEQ ID NO: 2832 - DNA, 181 bp, Homo sapiens; identical to SEQ ID NO: 563
  chr6:62996215-62996396
  hyper

SEQ ID NO: 2833 - DNA, 58 bp, Homo sapiens
  chr6:70992440-70992498
  hyper
cttcgataggactcgcggcaggtgctcgaggctggaggaagcgcgggtctgagagccc

SEQ ID NO: 2834 - DNA, 150 bp, Homo sapiens; identical to SEQ ID NO: 564
  chr6:73329801-73329951
  hyper

SEQ ID NO: 2835 - DNA, 164 bp, Homo sapiens; identical to SEQ ID NO: 565
  chr6:73330950-73331114
  hyper

SEQ ID NO: 2836 - DNA, 123 bp, Homo sapiens; identical to SEQ ID NO: 566
  chr6:73331115-73331238
  hyper

SEQ ID NO: 2837 - DNA, 390 bp, Homo sapiens; identical to SEQ ID NO: 567
  chr6:73331239-73331629
  hyper

SEQ ID NO: 2838 - DNA, 329 bp, Homo sapiens
  chr6:73332136-73332465
  hyper
ggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttct

SEQ ID NO: 2839 - DNA, 560 bp, Homo sapiens
  chr6:80656673-80657233
  hyper
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggagga

SEQ ID NO: 2840 - DNA, 272 bp, Homo sapiens; identical to SEQ ID NO: 568
  chr6:84417429-84417701
  hyper

SEQ ID NO: 2841 - DNA, 100 bp, Homo sapiens
  chr6:84419102-84419202
  hyper
ggcacgcactgggctcgcgcaccacgcacacctgcccgccgactgcggggggagccctgggcgttgggggcgttggccaagacgggcgagtgggcttctc

SEQ ID NO: 2842 - DNA, 126 bp, Homo sapiens
  chr6:84419203-84419329
  hyper
ggttctactctgtgaaggccaaggcaagggcgtcgtcgcgcgctgcctggcggagcccagccccttccccacactgtcgctgacacgcccgcctgtcaaaggctccgaggcccagatgagcagggc

SEQ ID NO: 2843 - DNA, 61 bp, Homo sapiens
  chr6:84419330-84419391
  hyper
attttaaatgtcagatcctgccggccatccgcgaccgtcacctgtgcgtcttcagctcctc

SEQ ID NO: 2844 - DNA, 110 bp, Homo sapiens
  chr6:84562820-84562930
  hyper
cggaaattggctgctcgggcgaatgttgtttttctccgcagccatgtgtcgaagggcgattaacattcgctcgacaaaaccctgtcccgggccatttgggagttgcacgc

SEQ ID NO: 2845 - DNA, 354 bp, Homo sapiens
  chr6:84562931-84563285
  hyper
ttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctg

SEQ ID NO: 2846 - DNA, 437 bp, Homo sapiens
  chr6:84563416-84563853
  hyper
cgcaggcttctggagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 2847 - DNA, 866 bp, Homo sapiens; identical to SEQ ID NO: 569
  chr6:85472401-85473267
  hyper

SEQ ID NO: 2848 - DNA, 694 bp, Homo sapiens; identical to SEQ ID NO: 570
  chr6:85473508-85474202
  hyper

SEQ ID NO: 2849 - DNA, 119 bp, Homo sapiens; identical to SEQ ID NO: 571
  chr6:85482703-85482822
  hyper

SEQ ID NO: 2850 - DNA, 69 bp, Homo sapiens
  chr6:85484557-85484626
  hyper
gggctgcgggcgggtgagcgccgccgggcaccgggcgggggcacgtggcgccctctggggaccgtccgc

SEQ ID NO: 2851 - DNA, 217 bp, Homo sapiens
  chr6:85484716-85484933
  hyper
cgctgacccctccacctggctgaaggcagcagccctgggagactctggcactctgggccggagcaggagctgtgccccatggcaacccagactgaaagggaagccctgtctgttgctctttgctgcggattcgagggaggccgtctcgagtcgctcagaagcgacctaaagaaggcactggcctctgtgcgccgaacctccacgagatagactaagt

SEQ ID NO: 2852 - DNA, 175 bp, Homo sapiens
  chr6:88876302-88876477
  hyper
ttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttc

SEQ ID NO: 2853 - DNA, 111 bp, Homo sapiens
  chr6:88876630-88876741
  hyper
ggggccgggctgagctttgggaccgcgctgcgcagcccccgagccgttcgctacctggctgcggtcgcgcggccacctgtcctccgccctcggggcgccgcccagcttcgc

SEQ ID NO: 2854 - DNA, 322 bp, Homo sapiens
  chr6:88876742-88877064
  hyper
ccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgcc

SEQ ID NO: 2855 - DNA, 208 bp, Homo sapiens
  chr6:88877065-88877273
  hyper
tctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgca

SEQ ID NO: 2856 - DNA, 184 bp, Homo sapiens
  chr6:94127476-94127660
  hyper
tttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagt

SEQ ID NO: 2857 - DNA, 736 bp, Homo sapiens; identical to SEQ ID NO: 572
  chr6:99271926-99272662
  hyper

SEQ ID NO: 2858 - DNA, 150 bp, Homo sapiens; identical to SEQ ID NO: 573
  chr6:99277180-99277330
  hyper

SEQ ID NO: 2859 - DNA, 105 bp, Homo sapiens; identical to SEQ ID NO: 574
  chr6:99295759-99295864
  hyper

SEQ ID NO: 2860 - DNA, 304 bp, Homo sapiens; identical to SEQ ID NO: 575
  chr6:99296061-99296365
  hyper

SEQ ID NO: 2861 - DNA, 49 bp, Homo sapiens; identical to SEQ ID NO: 576
  chr6:99296407-99296456
  hyper

SEQ ID NO: 2862 - DNA, 46 bp, Homo sapiens; identical to SEQ ID NO: 577
  chr6:100038661-100038707
  hyper

SEQ ID NO: 2863 - DNA, 369 bp, Homo sapiens; identical to SEQ ID NO: 578
  chr6:100038785-100039154
  hyper

SEQ ID NO: 2864 - DNA, 251 bp, Homo sapiens; identical to SEQ ID NO: 579
  chr6:100050858-100051109
  hyper

SEQ ID NO: 2865 - DNA, 149 bp, Homo sapiens; identical to SEQ ID NO: 580
  chr6:100051359-100051508
  hyper

SEQ ID NO: 2866 - DNA, 187 bp, Homo sapiens; identical to SEQ ID NO: 581
  chr6:100051771-100051958
  hyper

SEQ ID NO: 2867 - DNA, 430 bp, Homo sapiens
  chr6:100061022-100061452
  hyper
tgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccggga

SEQ ID NO: 2868 - DNA, 682 bp, Homo sapiens
  chr6:100061988-100062670
  hyper
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacaga

SEQ ID NO: 2869 - DNA, 2 bp, Homo sapiens
  chr6:100441306-100441308
  hyper
cg

SEQ ID NO: 2870 - DNA, 241 bp, Homo sapiens; identical to SEQ ID NO: 583
  chr6:100441497-100441738
  hyper

SEQ ID NO: 2871 - DNA, 337 bp, Homo sapiens; identical to SEQ ID NO: 584
  chr6:100441761-100442098
  hyper

SEQ ID NO: 2872 - DNA, 21 bp, Homo sapiens
  chr6:100903384-100903405
  hyper
tctctttctaaatcccggctc

SEQ ID NO: 2873 - DNA, 132 bp, Homo sapiens; identical to SEQ ID NO: 585
  chr6:100912919-100913051
  hyper

SEQ ID NO: 2874 - DNA, 59 bp, Homo sapiens
  chr6:101840708-101840767
  hyper
caatcttggagtctgcgacctcaggttcggcgcccactagatctcgaatccaacttctt

SEQ ID NO: 2875 - DNA, 104 bp, Homo sapiens; identical to SEQ ID NO: 586
  chr6:105389509-105389613
  hyper

SEQ ID NO: 2876 - DNA, 161 bp, Homo sapiens
  chr6:105401596-105401757
  hyper
cggccgcctggggagcgacctgcctggagaggcgggttgcgatggcagcgctgggctacagaccccgccttatttgcggggaggagaggacgggtggagtcacttgccgcattgccacagcccctcctcctagttttaagaagaaccgaagcattgtttct

SEQ ID NO: 2877 - DNA, 83 bp, Homo sapiens; identical to SEQ ID NO: 587
  chr6:105584133-105584216
  hyper

SEQ ID NO: 2878 - DNA, 103 bp, Homo sapiens; identical to SEQ ID NO: 588
  chr6:105584217-105584320
  hyper

SEQ ID NO: 2879 - DNA, 185 bp, Homo sapiens; identical to SEQ ID NO: 589
  chr6:105584366-105584551
  hyper

SEQ ID NO: 2880 - DNA, 1015 bp, Homo sapiens; identical to SEQ ID NO: 590
  chr6:105584552-105585567
  hyper

SEQ ID NO: 2881 - DNA, 427 bp, Homo sapiens; identical to SEQ ID NO: 591
  chr6:106429049-106429476
  hyper

SEQ ID NO: 2882 - DNA, 35 bp, Homo sapiens; identical to SEQ ID NO: 592
  chr6:106429589-106429624
  hyper

SEQ ID NO: 2883 - DNA, 1251 bp, Homo sapiens; identical to SEQ ID NO: 593
  chr6:106441869-106443120
  hyper

SEQ ID NO: 2884 - DNA, 715 bp, Homo sapiens
  chr6:108436072-108436787
  hyper
ggcttagcctgcctgcgatttccaacttctctttccacggatcgaccgcggccttggcaaggacttgagtctgcgttccagccccttccgctcccagcgcgcacgcagcctctcgcctttgcgtcggcgggttgctggttgccggtacccgctcagcagctaggagccttggggaaccctagctcttagcttccccgtctggcgaggccagagggccaagttgctcactgggctgtgctgagggataaggggagaaaagaacggaaatcgcagctacgagggctagagggacggcgcggctgcttgaggacgggtcgcctagcggtgggcgagtagggctgtgcgtaaaaggatctagacagacagtcgtgcgcccgcagggttgcaggacaggggcaggccgagttgtggcgcgtgtgtgtttgtgtgtgctcgcctccgggttgcgcgctttcagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcc

SEQ ID NO: 2885 - DNA, 15 bp, Homo sapiens
  chr6:108438142-108438157
  hyper
gcagcccaactgggg

SEQ ID NO: 2886 - DNA, 303 bp, Homo sapiens; identical to SEQ ID NO: 595
  chr6:108438260-108438563
  hyper

SEQ ID NO: 2887 - DNA, 567 bp, Homo sapiens; identical to SEQ ID NO: 596
  chr6:108440078-108440645
  hyper

SEQ ID NO: 2888 - DNA, 223 bp, Homo sapiens; identical to SEQ ID NO: 597
  chr6:108440744-108440967
  hyper

SEQ ID NO: 2889 - DNA, 822 bp, Homo sapiens
  chr6:108478874-108479696
  hyper
gtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtcccctcataagtcaagatataaaacgctttgtactgaatggcccatgatctggagcgctcaacttgggag

SEQ ID NO: 2890 - DNA, 246 bp, Homo sapiens
  chr6:108484872-108485118
  hyper
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcct

SEQ ID NO: 2891 - DNA, 494 bp, Homo sapiens
  chr6:108485513-108486007
  hyper
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctctctgggcgccgagttcgagaaagcgctacgccgccggtcgggctagctccacaagcggctgtacaagttggctgtcaaaaaacgctgatttctcctcctgtcacctaataaacccctacgcgcttatggcctcgtcccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcac

SEQ ID NO: 2892 - DNA, 386 bp, Homo sapiens
  chr6:108486008-108486394
  hyper
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcc

SEQ ID NO: 2893 - DNA, 665 bp, Homo sapiens; identical to SEQ ID NO: 598
  chr6:108487779-108488444
  hyper

SEQ ID NO: 2894 - DNA, 79 bp, Homo sapiens; identical to SEQ ID NO: 599
  chr6:108489730-108489809
  hyper

SEQ ID NO: 2895 - DNA, 180 bp, Homo sapiens; identical to SEQ ID NO: 600
  chr6:108490066-108490246
  hyper

SEQ ID NO: 2896 - DNA, 219 bp, Homo sapiens; identical to SEQ ID NO: 601
  chr6:108490296-108490515
  hyper

SEQ ID NO: 2897 - DNA, 60 bp, Homo sapiens; identical to SEQ ID NO: 602
  chr6:108490537-108490597
  hyper

SEQ ID NO: 2898 - DNA, 41 bp, Homo sapiens
  chr6:108490960-108491001
  hyper
cacaatctcccctcccgccctgtgggaggggggcgccgagc

SEQ ID NO: 2899 - DNA, 551 bp, Homo sapiens; identical to SEQ ID NO: 603
  chr6:108495915-108496466
  hyper

SEQ ID NO: 2900 - DNA, 460 bp, Homo sapiens
  chr6:110678940-110679400
  hyper
atagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 2901 - DNA, 265 bp, Homo sapiens
  chr6:110679401-110679666
  hyper
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctgga

SEQ ID NO: 2902 - DNA, 208 bp, Homo sapiens; identical to SEQ ID NO: 604
  chr6:117086271-117086479
  hyper

SEQ ID NO: 2903 - DNA, 160 bp, Homo sapiens; identical to SEQ ID NO: 605
  chr6:117086480-117086640
  hyper

SEQ ID NO: 2904 - DNA, 55 bp, Homo sapiens
  chr6:117586007-117586062
  hyper
agaaaggagcaggatcgaactttagaggggcagaagggcacggcccaagagagca

SEQ ID NO: 2905 - DNA, 310 bp, Homo sapiens; identical to SEQ ID NO: 606
  chr6:117591206-117591516
  hyper

SEQ ID NO: 2906 - DNA, 218 bp, Homo sapiens
  chr6:118228651-118228869
  hyper
gcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgcc

SEQ ID NO: 2907 - DNA, 344 bp, Homo sapiens
  chr6:118228870-118229214
  hyper
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgg

SEQ ID NO: 2908 - DNA, 37 bp, Homo sapiens; identical to SEQ ID NO: 607
  chr6:118229695-118229732
  hyper

SEQ ID NO: 2909 - DNA, 91 bp, Homo sapiens; identical to SEQ ID NO: 608
  chr6:118229733-118229824
  hyper

SEQ ID NO: 2910 - DNA, 35 bp, Homo sapiens
  chr6:123316972-123317007
  hyper
tgtctacaacaaatgcgaaaagtacagaatgtttc

SEQ ID NO: 2911 - DNA, 642 bp, Homo sapiens
  chr6:123317072-123317714
  hyper
cgtctacaacagctactctccaggctgatctggggtcttgcacacaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgc

SEQ ID NO: 2912 - DNA, 156 bp, Homo sapiens
  chr6:123317715-123317871
  hyper
gctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcga

SEQ ID NO: 2913 - DNA, 110 bp, Homo sapiens
  chr6:126068068-126068178
  hyper
cgttccctcattctttctcttttctttctctccacataacgcctcccctacacctccccacctccaatccactaccgtatttaagtcggcgggggcgctttaaagggttt

SEQ ID NO: 2914 - DNA, 104 bp, Homo sapiens
  chr6:127440406-127440510
  hyper
gcctcccggggaaggcgccagcgaagaagtaagtgcagggttttttacgcgtttgctccctcccgccgcgttcacctgtcgggtcgctttgcctgtccggagcc

SEQ ID NO: 2915 - DNA, 452 bp, Homo sapiens
  chr6:127440511-127440963
  hyper
gctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgag

SEQ ID NO: 2916 - DNA, 703 bp, Homo sapiens
  chr6:127441030-127441733
  hyper
cgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagat

SEQ ID NO: 2917 - DNA, 764 bp, Homo sapiens
  chr6:130686429-130687193
  hyper
ctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 2918 - DNA, 120 bp, Homo sapiens
  chr6:130687224-130687344
  hyper
cggtggcggcgccgcctgagcggcgactccctctcccctgcccggcttgctgcgcccggtgccctccgagggcaggcgcgcctggactctgcgcccggatggcggcggccctctgtgagc

SEQ ID NO: 2919 - DNA, 63 bp, Homo sapiens
  chr6:133562374-133562437
  hyper
cccccggcggcctcacgagcccgcagtagccggtggcgacgtcgcccccgccccacctccctg

SEQ ID NO: 2920 - DNA, 408 bp, Homo sapiens
  chr6:133562674-133563082
  hyper
ggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcc

SEQ ID NO: 2921 - DNA, 604 bp, Homo sapiens; identical to SEQ ID NO: 609
  chr6:133563411-133564015
  hyper

SEQ ID NO: 2922 - DNA, 437 bp, Homo sapiens; identical to SEQ ID NO: 610
  chr6:134210582-134211019
  hyper

SEQ ID NO: 2923 - DNA, 224 bp, Homo sapiens; identical to SEQ ID NO: 611
  chr6:134211111-134211335
  hyper

SEQ ID NO: 2924 - DNA, 35 bp, Homo sapiens; identical to SEQ ID NO: 612
  chr6:137244114-137244149
  hyper

SEQ ID NO: 2925 - DNA, 231 bp, Homo sapiens; identical to SEQ ID NO: 613
  chr6:137244235-137244466
  hyper

SEQ ID NO: 2926 - DNA, 258 bp, Homo sapiens; identical to SEQ ID NO: 614
  chr6:137809108-137809366
  hyper

SEQ ID NO: 2927 - DNA, 472 bp, Homo sapiens; identical to SEQ ID NO: 615
  chr6:137809445-137809917
  hyper

SEQ ID NO: 2928 - DNA, 929 bp, Homo sapiens; identical to SEQ ID NO: 616
  chr6:137810032-137810961
  hyper

SEQ ID NO: 2929 - DNA, 15 bp, Homo sapiens
  chr6:137814604-137814619
  hyper
cccagtgctggaagc

SEQ ID NO: 2930 - DNA, 110 bp, Homo sapiens
  chr6:137814653-137814763
  hyper
cgccttgagtagcgagtggggaggccggatggtgccgatggcgggaagtgaggcggcggacagcggtgacgaggcgttgccagatgagagcgcgccgcccaagatggggt

SEQ ID NO: 2931 - DNA, 151 bp, Homo sapiens; identical to SEQ ID NO: 617
  chr6:137815020-137815171
  hyper

SEQ ID NO: 2932 - DNA, 515 bp, Homo sapiens; identical to SEQ ID NO: 618
  chr6:137815224-137815739
  hyper

SEQ ID NO: 2933 - DNA, 777 bp, Homo sapiens; identical to SEQ ID NO: 619
  chr6:137816459-137817236
  hyper

SEQ ID NO: 2934 - DNA, 94 bp, Homo sapiens; identical to SEQ ID NO: 620
  chr6:137818505-137818599
  hyper

SEQ ID NO: 2935 - DNA, 649 bp, Homo sapiens; identical to SEQ ID NO: 621
  chr6:137818618-137819267
  hyper

SEQ ID NO: 2936 - DNA, 280 bp, Homo sapiens; identical to SEQ ID NO: 622
  chr6:137819268-137819548
  hyper

SEQ ID NO: 2937 - DNA, 165 bp, Homo sapiens
  chr6:146755496-146755661
  hyper
ggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagct

SEQ ID NO: 2938 - DNA, 52 bp, Homo sapiens; identical to SEQ ID NO: 623
  chr6:150285317-150285369
  hyper

SEQ ID NO: 2939 - DNA, 342 bp, Homo sapiens; identical to SEQ ID NO: 624
  chr6:150285544-150285886
  hyper

SEQ ID NO: 2940 - DNA, 429 bp, Homo sapiens; identical to SEQ ID NO: 625
  chr6:150286099-150286528
  hyper

SEQ ID NO: 2941 - DNA, 74 bp, Homo sapiens
  chr6:155316256-155316330
  hyper
cgatgtttcttgaattgttttatttgtgttgttccaaagaaagcgcgagggacatggtccgggaccagccggga

SEQ ID NO: 2942 - DNA, 533 bp, Homo sapiens; identical to SEQ ID NO: 626
  chr6:157556764-157557297
  hyper

SEQ ID NO: 2943 - DNA, 39 bp, Homo sapiens
  chr6:159590048-159590087
  hyper
ggaactacagcgctgcggaccgggtgaggggtcccggcc

SEQ ID NO: 2944 - DNA, 608 bp, Homo sapiens
  chr6:159590154-159590762
  hyper
cgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccgg

SEQ ID NO: 2945 - DNA, 278 bp, Homo sapiens
  chr6:159590971-159591249
  hyper
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgc

SEQ ID NO: 2946 - DNA, 350 bp, Homo sapiens
  chr6:166267542-166267892
  hyper
ctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 2947 - DNA, 256 bp, Homo sapiens
  chr6:166402395-166402651
  hyper
ggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 2948 - DNA, 49 bp, Homo sapiens
  chr6:166421943-166421992
  hyper
aggagcgggtcgcgccgctgacattcgccaaggacaggatggggtgggc

SEQ ID NO: 2949 - DNA, 192 bp, Homo sapiens
  chr6:166421993-166422185
  hyper
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggg

SEQ ID NO: 2950 - DNA, 1231 bp, Homo sapiens; identical to SEQ ID NO: 627
  chr6:166579715-166580946
  hyper

SEQ ID NO: 2951 - DNA, 1021 bp, Homo sapiens; identical to SEQ ID NO: 628
  chr6:166581218-166582239
  hyper

SEQ ID NO: 2952 - DNA, 292 bp, Homo sapiens
  chr6:166582505-166582797
  hyper
caaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctgggg

SEQ ID NO: 2953 - DNA, 163 bp, Homo sapiens
  chr7:751986-752149
  hyper
gcatccccggggggcctcccaggcccggggctcccggcgcagaccccagcccggccccgcgtacctggatgcgcggcgcccgaggccaggaggcggctgcgcggggacgcggggcgcggggacggctggcgagcgagcgagcgggtccccgcactgcagcggc

SEQ ID NO: 2954 - DNA, 112 bp, Homo sapiens
  chr7:752150-752262
  hyper
ccgccctccacgcccgcccccgcgccgcgcgcagctgctgcacccccaacgccgcccgcgcgggcctgcagcccgtctccccccgaccgcctccccgcggggcccccaaccc

SEQ ID NO: 2955 - DNA, 124 bp, Homo sapiens
  chr7:1408647-1408771
  hyper
gagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 2956 - DNA, 34 bp, Homo sapiens
  chr7:1408874-1408908
  hyper
cgcggaccccggcccatcccggaccccgcccacc

SEQ ID NO: 2957 - DNA, 34 bp, Homo sapiens
  chr7:4923327-4923361
  hyper
ggcggcgcaacgggcggggcggggcctcaagggg

SEQ ID NO: 2958 - DNA, 386 bp, Homo sapiens
  chr7:4998201-4998587
  hyper
gtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 2959 - DNA, 154 bp, Homo sapiens
  chr7:8473139-8473293
  hyper
cgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctc

SEQ ID NO: 2960 - DNA, 607 bp, Homo sapiens; identical to SEQ ID NO: 629
  chr7:8473635-8474242
  hyper

SEQ ID NO: 2961 - DNA, 47 bp, Homo sapiens; identical to SEQ ID NO: 630
  chr7:8474515-8474562
  hyper

SEQ ID NO: 2962 - DNA, 264 bp, Homo sapiens; identical to SEQ ID NO: 631
  chr7:8480763-8481027
  hyper

SEQ ID NO: 2963 - DNA, 61 bp, Homo sapiens
  chr7:8481642-8481703
  hyper
cggggtggtggaaagcgagatggcgttgggagccagggcgttgggacggcacaagcagtgg

SEQ ID NO: 2964 - DNA, 282 bp, Homo sapiens
  chr7:8482016-8482298
  hyper
cctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 2965 - DNA, 156 bp, Homo sapiens
  chr7:8482669-8482825
  hyper
cgctgccgctccggctgggtccttaaagtcgagttagcactctcggtttccgcagatacctcctcaaggcccgctcgcgactgtgacgacccgcctaccccttccagctattcggggggcagctagctcccgtctctaggtccccagcatgacctg

SEQ ID NO: 2966 - DNA, 139 bp, Homo sapiens
  chr7:8482884-8483023
  hyper
cgtgatcaccacggagattttgcgaatccttcttttccccaacttctccccctacccagtctcccattctttcacagttcattaaatctacccctcccccgaaacagaaacgtgaaggctgtaacgaagagctagaagt

SEQ ID NO: 2967 - DNA, 596 bp, Homo sapiens; identical to SEQ ID NO: 632
  chr7:8483358-8483954
  hyper

SEQ ID NO: 2968 - DNA, 37 bp, Homo sapiens; identical to SEQ ID NO: 633
  chr7:19145857-19145894
  hyper

SEQ ID NO: 2969 - DNA, 154 bp, Homo sapiens; identical to SEQ ID NO: 634
  chr7:19146031-19146185
  hyper

SEQ ID NO: 2970 - DNA, 345 bp, Homo sapiens; identical to SEQ ID NO: 635
  chr7:19146237-19146582
  hyper

SEQ ID NO: 2971 - DNA, 932 bp, Homo sapiens; identical to SEQ ID NO: 636
  chr7:19146942-19147874
  hyper

SEQ ID NO: 2972 - DNA, 8 bp, Homo sapiens
  chr7:19156125-19156133
  hyper
cggccttc

SEQ ID NO: 2973 - DNA, 340 bp, Homo sapiens; identical to SEQ ID NO: 638
  chr7:19156303-19156643
  hyper

SEQ ID NO: 2974 - DNA, 43 bp, Homo sapiens; identical to SEQ ID NO: 639
  chr7:19156703-19156746
  hyper

SEQ ID NO: 2975 - DNA, 138 bp, Homo sapiens; identical to SEQ ID NO: 640
  chr7:19157055-19157193
  hyper

SEQ ID NO: 2976 - DNA, 69 bp, Homo sapiens; identical to SEQ ID NO: 641
  chr7:19157194-19157263
  hyper

SEQ ID NO: 2977 - DNA, 303 bp, Homo sapiens; identical to SEQ ID NO: 642
  chr7:19157264-19157567
  hyper

SEQ ID NO: 2978 - DNA, 302 bp, Homo sapiens; identical to SEQ ID NO: 643
  chr7:19157633-19157935
  hyper

SEQ ID NO: 2979 - DNA, 268 bp, Homo sapiens
  chr7:19184148-19184416
  hyper
aaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctc

SEQ ID NO: 2980 - DNA, 156 bp, Homo sapiens; identical to SEQ ID NO: 644
  chr7:20816291-20816447
  hyper

SEQ ID NO: 2981 - DNA, 70 bp, Homo sapiens; identical to SEQ ID NO: 645
  chr7:20823261-20823331
  hyper

SEQ ID NO: 2982 - DNA, 497 bp, Homo sapiens; identical to SEQ ID NO: 646
  chr7:20823382-20823879
  hyper

SEQ ID NO: 2983 - DNA, 90 bp, Homo sapiens; identical to SEQ ID NO: 647
  chr7:20823919-20824009
  hyper

SEQ ID NO: 2984 - DNA, 275 bp, Homo sapiens
  chr7:20824475-20824750
  hyper
cgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtccc

SEQ ID NO: 2985 - DNA, 545 bp, Homo sapiens; identical to SEQ ID NO: 648
  chr7:22589325-22589870
  hyper

SEQ ID NO: 2986 - DNA, 98 bp, Homo sapiens
  chr7:23287253-23287351
  hyper
ctgggcctgggattgcggggacgggacgggtgggaagcggccaaaggcgcagcggcttctggtcagagccgcagaggcctgagacgtgggccgcgccc

SEQ ID NO: 2987 - DNA, 92 bp, Homo sapiens
  chr7:23287532-23287624
  hyper
ggcactgtgatggtcccgcttcccacacgaggccacgggccacagagtgggcaaggaactcgccccaagccacacagcgggtaagttgagga

SEQ ID NO: 2988 - DNA, 159 bp, Homo sapiens; identical to SEQ ID NO: 649
  chr7:25896441-25896600
  hyper

SEQ ID NO: 2989 - DNA, 278 bp, Homo sapiens; identical to SEQ ID NO: 650
  chr7:25896660-25896938
  hyper

SEQ ID NO: 2990 - DNA, 505 bp, Homo sapiens; identical to SEQ ID NO: 651
  chr7:27135266-27135771
  hyper

SEQ ID NO: 2991 - DNA, 445 bp, Homo sapiens; identical to SEQ ID NO: 652
  chr7:27135979-27136424
  hyper

SEQ ID NO: 2992 - DNA, 324 bp, Homo sapiens; identical to SEQ ID NO: 653
  chr7:27136425-27136749
  hyper

SEQ ID NO: 2993 - DNA, 699 bp, Homo sapiens; identical to SEQ ID NO: 654
  chr7:27190372-27191071
  hyper

SEQ ID NO: 2994 - DNA, 16 bp, Homo sapiens
  chr7:27195586-27195602
  hyper
atgctatgggctccac

SEQ ID NO: 2995 - DNA, 27 bp, Homo sapiens
  chr7:27195866-27195893
  hyper
cgcctttggcgaggtcactgcagagcc

SEQ ID NO: 2996 - DNA, 1 bp, Homo sapiens
  chr7:27196152-27196153
  hyper
c

SEQ ID NO: 2997 - DNA, 132 bp, Homo sapiens; identical to SEQ ID NO: 658
  chr7:27196154-27196286
  hyper

SEQ ID NO: 2998 - DNA, 351 bp, Homo sapiens; identical to SEQ ID NO: 659
  chr7:27196287-27196638
  hyper

SEQ ID NO: 2999 - DNA, 324 bp, Homo sapiens; identical to SEQ ID NO: 660
  chr7:27212660-27212984
  hyper

SEQ ID NO: 3000 - DNA, 796 bp, Homo sapiens; identical to SEQ ID NO: 661
  chr7:27213188-27213984
  hyper

SEQ ID NO: 3001 - DNA, 277 bp, Homo sapiens; identical to SEQ ID NO: 662
  chr7:27213985-27214262
  hyper

SEQ ID NO: 3002 - DNA, 633 bp, Homo sapiens
  chr7:27223976-27224609
  hyper
ataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggg

SEQ ID NO: 3003 - DNA, 680 bp, Homo sapiens
  chr7:27232300-27232980
  hyper
ggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacacccca

SEQ ID NO: 3004 - DNA, 378 bp, Homo sapiens; identical to SEQ ID NO: 663
  chr7:27244932-27245310
  hyper

SEQ ID NO: 3005 - DNA, 437 bp, Homo sapiens; identical to SEQ ID NO: 664
  chr7:27264875-27265312
  hyper

SEQ ID NO: 3006 - DNA, 46 bp, Homo sapiens
  chr7:27265538-27265584
  hyper
aaatgcagaggaagccggggacactgaagcccgggtggttgcagtg

SEQ ID NO: 3007 - DNA, 132 bp, Homo sapiens; identical to SEQ ID NO: 665
  chr7:27279237-27279369
  hyper

SEQ ID NO: 3008 - DNA, 18 bp, Homo sapiens
  chr7:27279453-27279471
  hyper
cgccgggcctggagcggc

SEQ ID NO: 3009 - DNA, 118 bp, Homo sapiens
  chr7:27285707-27285825
  hyper
cgcctcgcccttcagcggctcgctgcgcccgctcgacacgttccgcgtgctgtcgcagccctacccgcggcccgaactgctgtgcgccttccgccacccgccgctctaccccgggccc

SEQ ID NO: 3010 - DNA, 173 bp, Homo sapiens; identical to SEQ ID NO: 667
  chr7:27290946-27291119
  hyper

SEQ ID NO: 3011 - DNA, 537 bp, Homo sapiens; identical to SEQ ID NO: 668
  chr7:27291314-27291851
  hyper

SEQ ID NO: 3012 - DNA, 38 bp, Homo sapiens
  chr7:28449253-28449291
  hyper
ttgtaaacattttggcggaccagagggaagtccggccc

SEQ ID NO: 3013 - DNA, 124 bp, Homo sapiens
  chr7:28449658-28449782
  hyper
cgaggacgccgggtcacctagggggcgggtgggcgcgcgcgcagggggctcgctctccccggtgcggagctgcagctgccacctctcccgccgggctgccggctgcagcgggtgggcgcgcgcc

SEQ ID NO: 3014 - DNA, 184 bp, Homo sapiens
  chr7:28449857-28450041
  hyper
cgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttg

SEQ ID NO: 3015 - DNA, 332 bp, Homo sapiens
  chr7:29185865-29186197
  hyper
atttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctc

SEQ ID NO: 3016 - DNA, 476 bp, Homo sapiens; identical to SEQ ID NO: 669
  chr7:30721202-30721678
  hyper

SEQ ID NO: 3017 - DNA, 89 bp, Homo sapiens
  chr7:32110706-32110795
  hyper
cgtctgccgggcacacgctgggctccgaccccggccgggcacactcacccccgcagggcagccgcggccaccaccgacctgcggagctg

SEQ ID NO: 3018 - DNA, 73 bp, Homo sapiens
  chr7:32338145-32338218
  hyper
cctccggccccagcccgacccctgagctccccctgcccgcttagaaaggaactctgaccgccaccggagaggg

SEQ ID NO: 3019 - DNA, 305 bp, Homo sapiens
  chr7:32338283-32338588
  hyper
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctc

SEQ ID NO: 3020 - DNA, 237 bp, Homo sapiens; identical to SEQ ID NO: 670
  chr7:32467419-32467656
  hyper

SEQ ID NO: 3021 - DNA, 69 bp, Homo sapiens; identical to SEQ ID NO: 671
  chr7:32467946-32468015
  hyper

SEQ ID NO: 3022 - DNA, 266 bp, Homo sapiens; identical to SEQ ID NO: 672
  chr7:33943692-33943958
  hyper

SEQ ID NO: 3023 - DNA, 554 bp, Homo sapiens
  chr7:35225280-35225834
  hyper
aagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgtt

SEQ ID NO: 3024 - DNA, 420 bp, Homo sapiens
  chr7:35226044-35226464
  hyper
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcc

SEQ ID NO: 3025 - DNA, 296 bp, Homo sapiens; identical to SEQ ID NO: 673
  chr7:35293182-35293478
  hyper

SEQ ID NO: 3026 - DNA, 110 bp, Homo sapiens; identical to SEQ ID NO: 674
  chr7:35294031-35294141
  hyper

SEQ ID NO: 3027 - DNA, 73 bp, Homo sapiens
  chr7:35294502-35294575
  hyper
cgaaccttatggtagcgcccggactaagcggacacagacccctctggttttacaaaggcggctgtgacgagga

SEQ ID NO: 3028 - DNA, 53 bp, Homo sapiens; identical to SEQ ID NO: 675
  chr7:35296952-35297005
  hyper

SEQ ID NO: 3029 - DNA, 217 bp, Homo sapiens; identical to SEQ ID NO: 676
  chr7:35297137-35297354
  hyper

SEQ ID NO: 3030 - DNA, 547 bp, Homo sapiens; identical to SEQ ID NO: 677
  chr7:35297470-35298017
  hyper

SEQ ID NO: 3031 - DNA, 500 bp, Homo sapiens; identical to SEQ ID NO: 678
  chr7:35301244-35301744
  hyper

SEQ ID NO: 3032 - DNA, 147 bp, Homo sapiens; identical to SEQ ID NO: 679
  chr7:37487113-37487260
  hyper

SEQ ID NO: 3033 - DNA, 74 bp, Homo sapiens; identical to SEQ ID NO: 680
  chr7:37487380-37487454
  hyper

SEQ ID NO: 3034 - DNA, 71 bp, Homo sapiens; identical to SEQ ID NO: 681
  chr7:37487755-37487826
  hyper

SEQ ID NO: 3035 - DNA, 878 bp, Homo sapiens
  chr7:37488141-37489019
  hyper
aaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacc

SEQ ID NO: 3036 - DNA, 268 bp, Homo sapiens; identical to SEQ ID NO: 682
  chr7:38670396-38670664
  hyper

SEQ ID NO: 3037 - DNA, 15 bp, Homo sapiens
  chr7:43152193-43152208
  hyper
gggaggggatgcaag

SEQ ID NO: 3038 - DNA, 502 bp, Homo sapiens
  chr7:43152413-43152915
  hyper
cgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcc

SEQ ID NO: 3039 - DNA, 279 bp, Homo sapiens
  chr7:45613535-45613814
  hyper
ccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 3040 - DNA, 880 bp, Homo sapiens
  chr7:45613857-45614737
  hyper
cgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtca

SEQ ID NO: 3041 - DNA, 198 bp, Homo sapiens; identical to SEQ ID NO: 683
  chr7:49812820-49813018
  hyper

SEQ ID NO: 3042 - DNA, 197 bp, Homo sapiens; identical to SEQ ID NO: 684
  chr7:49813809-49814006
  hyper

SEQ ID NO: 3043 - DNA, 134 bp, Homo sapiens; identical to SEQ ID NO: 685
  chr7:49815116-49815250
  hyper

SEQ ID NO: 3044 - DNA, 109 bp, Homo sapiens; identical to SEQ ID NO: 686
  chr7:49815656-49815765
  hyper

SEQ ID NO: 3045 - DNA, 256 bp, Homo sapiens
  chr7:50343234-50343490
  hyper
gccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 3046 - DNA, 320 bp, Homo sapiens
  chr7:50343974-50344294
  hyper
ggctgcggggcaggtcgagcagggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggagaaatggggaacaatgcgagtgagcaacttcaggaagtcattgtgaaagaaagctgggaagagctccgc

SEQ ID NO: 3047 - DNA, 36 bp, Homo sapiens
  chr7:50344295-50344331
  hyper
gccaagttagcaggacactctaacaagtgactgcgc

SEQ ID NO: 3048 - DNA, 406 bp, Homo sapiens
  chr7:50344332-50344738
  hyper
gcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 3049 - DNA, 289 bp, Homo sapiens
  chr7:54612441-54612730
  hyper
ggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaa

SEQ ID NO: 3050 - DNA, 180 bp, Homo sapiens
  chr7:64974270-64974450
  hyper
cgggggctaaaagccgcaaaaagccgcggaggggggagcgaaaagcagtgggagctggggcaaaaaaccacaaaaagccgaggcagcggcggcagaaaacctcggcagcgggggcaaaaagctgcagcggcaaaaagcggcgacgggggcaaaaagccgcggtggcaaaaatgcgcggcg

SEQ ID NO: 3051 - DNA, 480 bp, Homo sapiens
  chr7:64974510-64974990
  hyper
cacaaaaagccgcggcagcggcggcagaaaacctcggcagcgggggcaaaaagccacggtggcgggggtaaaaagcagcggtggcaagaagccgcgacggtgggggcaagaagccgcggcggcccaggcaaaaggccgcaaaagccgcggcgacgggggcgaaaagccgcggcggcggaggcaaaaagccgcgacggcagggggcaaaaagctgcaaaagcctcggtgcgggtgaaaaaagtcgcggcgagaaaaagccgctgaggcgggggcaaaaagccgcggcggcaggggcgaaaaccagcaaaaagccgccgcggtgggggcaaaaagcagtgggagctggggtaaaaaaccacaaaaaaccgcggcagcggcggcagcaagccacggcggcgggggcaaaaagccgcggcggcaaaaacccggggtggcaaaaagccgcggcgccgggggacgaaaagcttcaaaggccgcttc

SEQ ID NO: 3052 - DNA, 235 bp, Homo sapiens
  chr7:70596453-70596688
  hyper
cgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctc

SEQ ID NO: 3053 - DNA, 126 bp, Homo sapiens
  chr7:71800631-71800757
  hyper
gggaactgcaggcaccgcttcacccaggagctacgggcttcgacccaaatggaagaaaggcgccttcctcacacaagcctcgtccaagaaaaaagagcagtgggaaacgatggtgggctggtggcc

SEQ ID NO: 3054 - DNA, 40 bp, Homo sapiens
  chr7:71800933-71800973
  hyper
cgctagtccggagaaactaggaacccgagtaaacccagac

SEQ ID NO: 3055 - DNA, 72 bp, Homo sapiens; identical to SEQ ID NO: 687
  chr7:71802451-71802523
  hyper

SEQ ID NO: 3056 - DNA, 95 bp, Homo sapiens; identical to SEQ ID NO: 688
  chr7:71802577-71802672
  hyper

SEQ ID NO: 3057 - DNA, 644 bp, Homo sapiens; identical to SEQ ID NO: 689
  chr7:79083190-79083834
  hyper

SEQ ID NO: 3058 - DNA, 510 bp, Homo sapiens
  chr7:86273208-86273718
  hyper
ccctctccaggggctcgcagtgtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgac

SEQ ID NO: 3059 - DNA, 13 bp, Homo sapiens
  chr7:86273719-86273732
  hyper
gcttcagcctggt

SEQ ID NO: 3060 - DNA, 335 bp, Homo sapiens; identical to SEQ ID NO: 690
  chr7:87229568-87229903
  hyper

SEQ ID NO: 3061 - DNA, 131 bp, Homo sapiens
  chr7:87230213-87230344
  hyper
ctgtggcaaagagagcgaagcggctgtgctcagcccacgccccggcgctgttcctgcccagccaatcagcctcaccacagatgactgctcccggcccggattgactgaatgctgattcctcgagaaactgc

SEQ ID NO: 3062 - DNA, 178 bp, Homo sapiens
  chr7:87230345-87230523
  hyper
aaacaggttgaatttccaggaggaatgttctggcttccgttgcacctctctagaaagggcaagtagagaaacgcgcatcagctgaatcattggggacatttcaacttatgtagacacgtctttcaaagttcacataagtcttcatatccatataactacaggacgtagttaagggaaa

SEQ ID NO: 3063 - DNA, 40 bp, Homo sapiens
  chr7:88388606-88388646
  hyper
cctcctgggcagccccgagcccacagctcccagcagaggc

SEQ ID NO: 3064 - DNA, 255 bp, Homo sapiens
  chr7:88388647-88388902
  hyper
ctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcagg

SEQ ID NO: 3065 - DNA, 207 bp, Homo sapiens
  chr7:88389046-88389253
  hyper
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctgg

SEQ ID NO: 3066 - DNA, 467 bp, Homo sapiens
  chr7:89950183-89950650
  hyper
tcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctaga

SEQ ID NO: 3067 - DNA, 402 bp, Homo sapiens
  chr7:94284694-94285096
  hyper
agcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 3068 - DNA, 96 bp, Homo sapiens; identical to SEQ ID NO: 691
  chr7:96621715-96621811
  hyper

SEQ ID NO: 3069 - DNA, 180 bp, Homo sapiens
  chr7:96622169-96622349
  hyper
acttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 3070 - DNA, 112 bp, Homo sapiens
  chr7:96625974-96626086
  hyper
gagcctgacaggtcccgggtcccaggtcccaggcagccccggccggggcagggccaagaccgcgtgcccaggacaagtaagtaactcaaacccgacccggcaagcgtggccc

SEQ ID NO: 3071 - DNA, 340 bp, Homo sapiens; identical to SEQ ID NO: 692
  chr7:96636033-96636373
  hyper

SEQ ID NO: 3072 - DNA, 65 bp, Homo sapiens
  chr7:96636595-96636660
  hyper
cgggcacaggggccccgctccgcccggacagctgccgccttgctgcgctgcgcaccccagagagc

SEQ ID NO: 3073 - DNA, 370 bp, Homo sapiens
  chr7:96647849-96648219
  hyper
ctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcg

SEQ ID NO: 3074 - DNA, 240 bp, Homo sapiens; identical to SEQ ID NO: 693
  chr7:96653580-96653820
  hyper

SEQ ID NO: 3075 - DNA, 131 bp, Homo sapiens; identical to SEQ ID NO: 694
  chr7:96653862-96653993
  hyper

SEQ ID NO: 3076 - DNA, 63 bp, Homo sapiens
  chr7:97361360-97361423
  hyper
ggctgggataaataccgcaaggcactgagcaggcgaaagagcgcgctcggacctccttcccgg

SEQ ID NO: 3077 - DNA, 507 bp, Homo sapiens
  chr7:97362198-97362705
  hyper
ttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagcc

SEQ ID NO: 3078 - DNA, 222 bp, Homo sapiens
  chr7:97362706-97362928
  hyper
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgc

SEQ ID NO: 3079 - DNA, 223 bp, Homo sapiens; identical to SEQ ID NO: 695
  chr7:98245856-98246079
  hyper

SEQ ID NO: 3080 - DNA, 204 bp, Homo sapiens; identical to SEQ ID NO: 696
  chr7:98246304-98246508
  hyper

SEQ ID NO: 3081 - DNA, 1085 bp, Homo sapiens; identical to SEQ ID NO: 697
  chr7:98246533-98247618
  hyper

SEQ ID NO: 3082 - DNA, 390 bp, Homo sapiens
  chr7:103085842-103086232
  hyper
gcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggatta

SEQ ID NO: 3083 - DNA, 554 bp, Homo sapiens
  chr7:103629059-103629613
  hyper
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggt

SEQ ID NO: 3084 - DNA, 251 bp, Homo sapiens
  chr7:103968915-103969166
  hyper
cgccttcagctgcagcagctgcagcggcggcggcgggaagaggggtggagggtggtgaggagggccggagcccgggccaggagggagggaggggagccgggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgc

SEQ ID NO: 3085 - DNA, 355 bp, Homo sapiens
  chr7:103969167-103969522
  hyper
ctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctcca

SEQ ID NO: 3086 - DNA, 15 bp, Homo sapiens
  chr7:103969562-103969577
  hyper
cggcctctccatgat

SEQ ID NO: 3087 - DNA, 766 bp, Homo sapiens
  chr7:107301015-107301781
  hyper
ccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 3088 - DNA, 302 bp, Homo sapiens; identical to SEQ ID NO: 698
  chr7:108097189-108097491
  hyper

SEQ ID NO: 3089 - DNA, 503 bp, Homo sapiens; identical to SEQ ID NO: 699
  chr7:116962644-116963147
  hyper

SEQ ID NO: 3090 - DNA, 68 bp, Homo sapiens; identical to SEQ ID NO: 700
  chr7:116963330-116963398
  hyper

SEQ ID NO: 3091 - DNA, 392 bp, Homo sapiens; identical to SEQ ID NO: 701
  chr7:117119505-117119897
  hyper

SEQ ID NO: 3092 - DNA, 254 bp, Homo sapiens; identical to SEQ ID NO: 702
  chr7:121939991-121940245
  hyper

SEQ ID NO: 3093 - DNA, 25 bp, Homo sapiens
  chr7:121940433-121940458
  hyper
cggtgtggaccgatggtggattctc

SEQ ID NO: 3094 - DNA, 306 bp, Homo sapiens; identical to SEQ ID NO: 704
  chr7:121941881-121942187
  hyper

SEQ ID NO: 3095 - DNA, 15 bp, Homo sapiens
  chr7:121943974-121943989
  hyper
ccgggtggcatgggc

SEQ ID NO: 3096 - DNA, 123 bp, Homo sapiens; identical to SEQ ID NO: 706
  chr7:121944176-121944299
  hyper

SEQ ID NO: 3097 - DNA, 488 bp, Homo sapiens; identical to SEQ ID NO: 707
  chr7:121946495-121946983
  hyper

SEQ ID NO: 3098 - DNA, 64 bp, Homo sapiens; identical to SEQ ID NO: 708
  chr7:121947097-121947161
  hyper

SEQ ID NO: 3099 - DNA, 128 bp, Homo sapiens; identical to SEQ ID NO: 709
  chr7:121950137-121950265
  hyper

SEQ ID NO: 3100 - DNA, 125 bp, Homo sapiens; identical to SEQ ID NO: 710
  chr7:121950428-121950553
  hyper

SEQ ID NO: 3101 - DNA, 148 bp, Homo sapiens; identical to SEQ ID NO: 711
  chr7:121951863-121952011
  hyper

SEQ ID NO: 3102 - DNA, 15 bp, Homo sapiens
  chr7:121952043-121952058
  hyper
cgagggtgggaaggg

SEQ ID NO: 3103 - DNA, 88 bp, Homo sapiens
  chr7:121955425-121955513
  hyper
tttctctctctgttccgcttgcagtttgcaagtgtatccttctgttgcatccctgaattgggacgcaggacatcgttctaggctccca

SEQ ID NO: 3104 - DNA, 124 bp, Homo sapiens; identical to SEQ ID NO: 713
  chr7:121956458-121956582
  hyper

SEQ ID NO: 3105 - DNA, 123 bp, Homo sapiens; identical to SEQ ID NO: 714
  chr7:121956954-121957077
  hyper

SEQ ID NO: 3106 - DNA, 153 bp, Homo sapiens; identical to SEQ ID NO: 715
  chr7:127744057-127744210
  hyper

SEQ ID NO: 3107 - DNA, 459 bp, Homo sapiens; identical to SEQ ID NO: 716
  chr7:127744211-127744670
  hyper

SEQ ID NO: 3108 - DNA, 835 bp, Homo sapiens
  chr7:127807845-127808680
  hyper
caacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttct

SEQ ID NO: 3109 - DNA, 159 bp, Homo sapiens
  chr7:127841338-127841497
  hyper
cggccgcctgacctcctcttggagttcccggctcagggcagggggtcgcgtccctgcggtctctggaggccacgccccacccgggcccaccggggtgggcgtggctacgtggctccctggcgctgaggcgcctccttcccaggtgggcggggctcctgc

SEQ ID NO: 3110 - DNA, 100 bp, Homo sapiens; identical to SEQ ID NO: 717
  chr7:128337422-128337522
  hyper

SEQ ID NO: 3111 - DNA, 13 bp, Homo sapiens
  chr7:128337582-128337595
  hyper
cgcctggaaatac

SEQ ID NO: 3112 - DNA, 134 bp, Homo sapiens; identical to SEQ ID NO: 719
  chr7:128337787-128337921
  hyper

SEQ ID NO: 3113 - DNA, 125 bp, Homo sapiens
  chr7:128430757-128430882
  hyper
tggctcgcagcccaccgggtgtgggaccggaagggaagacagggcggaggagagggggtcttccggccctgaggcttgatggggccaccggagggctcctcctaagagggtccttggccctggct

SEQ ID NO: 3114 - DNA, 560 bp, Homo sapiens
  chr7:128470497-128471057
  hyper
gagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 3115 - DNA, 90 bp, Homo sapiens
  chr7:128471125-128471215
  hyper
cggggagctgagagacagggcggagggcaccccccggtatagagagaagaccctggccccggccctcccacccatcgacaagggccatgg

SEQ ID NO: 3116 - DNA, 8 bp, Homo sapiens
  chr7:129421701-129421709
  hyper
cccaggac

SEQ ID NO: 3117 - DNA, 854 bp, Homo sapiens; identical to SEQ ID NO: 721
  chr7:129422115-129422969
  hyper

SEQ ID NO: 3118 - DNA, 299 bp, Homo sapiens; identical to SEQ ID NO: 722
  chr7:129423125-129423424
  hyper

SEQ ID NO: 3119 - DNA, 1355 bp, Homo sapiens; identical to SEQ ID NO: 723
  chr7:129424591-129425946
  hyper

SEQ ID NO: 3120 - DNA, 164 bp, Homo sapiens
  chr7:134143807-134143971
  hyper
ttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggc

SEQ ID NO: 3121 - DNA, 83 bp, Homo sapiens
  chr7:134143972-134144055
  hyper
gccttccccaagggtcggcggggatgcttcttccgcctggtcctagtggcagcggattctttccgcccccaacgctcgcccgc

SEQ ID NO: 3122 - DNA, 76 bp, Homo sapiens
  chr7:134144056-134144132
  hyper
ccccgcgtggcagaaaggagttcctcagctgctgtatctggtgggaaagcgaatgctttagcgaaaataacaggca

SEQ ID NO: 3123 - DNA, 99 bp, Homo sapiens
  chr7:136553927-136554026
  hyper
ctctcccgcctctcccgcctctcccgccccacccctacagtgtctcggcatcaactaatcttttccttttcttttgcaagatcaagggagaaagagaac

SEQ ID NO: 3124 - DNA, 263 bp, Homo sapiens
  chr7:136554103-136554366
  hyper
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcg

SEQ ID NO: 3125 - DNA, 63 bp, Homo sapiens
  chr7:136554903-136554966
  hyper
acagtgcctgggcttcgccacctaactcacaatgggtcctgaaccgcccgggcagtccccggg

SEQ ID NO: 3126 - DNA, 627 bp, Homo sapiens; identical to SEQ ID NO: 724
  chr7:137531262-137531889
  hyper

SEQ ID NO: 3127 - DNA, 176 bp, Homo sapiens; identical to SEQ ID NO: 725
  chr7:137531908-137532084
  hyper

SEQ ID NO: 3128 - DNA, 105 bp, Homo sapiens
  chr7:139167722-139167827
  hyper
cttgcagcggcagcacgtgggggagcccggggagccggcgcttccttccgcggggctggcccggccctctgcgtcgcagccgctctccgtccgggctgcagccag

SEQ ID NO: 3129 - DNA, 423 bp, Homo sapiens
  chr7:139168114-139168537
  hyper
cggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctg

SEQ ID NO: 3130 - DNA, 133 bp, Homo sapiens
  chr7:139208629-139208762
  hyper
accccggtgcaggagcgcgggcgcggcgcggcggagcgccccgcatggagccggcccgggagcccccctcgcgggcccggccgccgccgcccctcgccgcgcgccccgcgcccgcccccgccgcccccaggcc

SEQ ID NO: 3131 - DNA, 113 bp, Homo sapiens
  chr7:145813015-145813128
  hyper
ccccaacttcagcaccgcggacagcatcacctcccgcccagggagaggcgcgcgcctccttgctccgcccccgccccagctgatggaccccggccggtcggctcagtctccct

SEQ ID NO: 3132 - DNA, 113 bp, Homo sapiens; identical to SEQ ID NO: 726
  chr7:149112136-149112249
  hyper

SEQ ID NO: 3133 - DNA, 56 bp, Homo sapiens
  chr7:149917321-149917377
  hyper
cgggtctcttaccttgtggcctttccccgggggatacctgacgctattggagactc

SEQ ID NO: 3134 - DNA, 148 bp, Homo sapiens
  chr7:151106418-151106566
  hyper
ctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgc

SEQ ID NO: 3135 - DNA, 400 bp, Homo sapiens
  chr7:151106589-151106989
  hyper
cgctgcccgtcggggctcaggctcagccagttgatgcccccgcggtggtcggcgcagaccctcagggccgacccgccgccccccatcccgctggcagggcggggaacaagaaggagctgcgccccgctagggaggggcgccccggggtccgcgcggcggctccgtacgactgcggcccgcggccatcgcggggaacggggagcccgactcctgcggaggcacgcggcgaggggagggtgaaggaccctagctccccgctgcctccagcctctgggcccgcgaacccagggcgctgcggggggcggcccactcgggacctccgccctgggtagagtcctgggcgcgcgggcagagagaacccccttcccagcaccgctcggaggatccacaccccaccggg

SEQ ID NO: 3136 - DNA, 181 bp, Homo sapiens
  chr7:151107395-151107576
  hyper
cgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccc

SEQ ID NO: 3137 - DNA, 71 bp, Homo sapiens
  chr7:153583933-153584004
  hyper
ctctcccttctctcgcgggcgcagccgatcaatagttaacacccggctgcggacggcggctccatccgcgg

SEQ ID NO: 3138 - DNA, 194 bp, Homo sapiens
  chr7:153749733-153749927
  hyper
ggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggt

SEQ ID NO: 3139 - DNA, 2593 bp, Homo sapiens; identical to SEQ ID NO: 727
  chr7:155164445-155167038
  hyper

SEQ ID NO: 3140 - DNA, 51 bp, Homo sapiens; identical to SEQ ID NO: 728
  chr7:155167039-155167090
  hyper

SEQ ID NO: 3141 - DNA, 487 bp, Homo sapiens; identical to SEQ ID NO: 729
  chr7:155167174-155167661
  hyper

SEQ ID NO: 3142 - DNA, 634 bp, Homo sapiens
  chr7:155174224-155174858
  hyper
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagc

SEQ ID NO: 3143 - DNA, 61 bp, Homo sapiens; identical to SEQ ID NO: 730
  chr7:155241429-155241490
  hyper

SEQ ID NO: 3144 - DNA, 738 bp, Homo sapiens; identical to SEQ ID NO: 731
  chr7:155241491-155242229
  hyper

SEQ ID NO: 3145 - DNA, 742 bp, Homo sapiens
  chr7:155242699-155243441
  hyper
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaa

SEQ ID NO: 3146 - DNA, 208 bp, Homo sapiens
  chr7:155244031-155244239
  hyper
gaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaa

SEQ ID NO: 3147 - DNA, 491 bp, Homo sapiens; identical to SEQ ID NO: 732
  chr7:155246989-155247480
  hyper

SEQ ID NO: 3148 - DNA, 111 bp, Homo sapiens
  chr7:155249900-155250011
  hyper
aaatcttaaaaatagcgatcttcctgtgcgtgtccacctacgcgccccggggtgacctggcggggctgtcgccgggtgactcacacccctgaaccgcgaagcgacagggaa

SEQ ID NO: 3149 - DNA, 100 bp, Homo sapiens
  chr7:155252162-155252262
  hyper
tcatccccttccctacgatcttccaactcaggccaggccggggacgcatgccccagcccaccccagacttgtcctaccatccggttatcccggctgtgct

SEQ ID NO: 3150 - DNA, 146 bp, Homo sapiens
  chr7:155252316-155252462
  hyper
cgctgaccggtgggactcaggaggatgcacacagggaaggaggaaaataaaggcgccctttccccttggctccactttgtttgccagcgccagcccgcagtggtggggctcagcccccttcctgcacacagcgaggacaagggagg

SEQ ID NO: 3151 - DNA, 423 bp, Homo sapiens; identical to SEQ ID NO: 733
  chr7:155254901-155255324
  hyper

SEQ ID NO: 3152 - DNA, 2 bp, Homo sapiens
  chr7:155256231-155256233
  hyper
ac

SEQ ID NO: 3153 - DNA, 44 bp, Homo sapiens
  chr7:155256268-155256312
  hyper
cgctgtccccagtcccaccgcagtcctgccgcaggcctaaccct

SEQ ID NO: 3154 - DNA, 792 bp, Homo sapiens; identical to SEQ ID NO: 734
  chr7:155258072-155258864
  hyper

SEQ ID NO: 3155 - DNA, 164 bp, Homo sapiens; identical to SEQ ID NO: 735
  chr7:155258914-155259078
  hyper

SEQ ID NO: 3156 - DNA, 504 bp, Homo sapiens; identical to SEQ ID NO: 736
  chr7:155259119-155259623
  hyper

SEQ ID NO: 3157 - DNA, 12 bp, Homo sapiens
  chr7:155259833-155259845
  hyper
cggggattcgcc

SEQ ID NO: 3158 - DNA, 112 bp, Homo sapiens; identical to SEQ ID NO: 738
  chr7:155259846-155259958
  hyper

SEQ ID NO: 3159 - DNA, 99 bp, Homo sapiens; identical to SEQ ID NO: 739
  chr7:155260038-155260137
  hyper

SEQ ID NO: 3160 - DNA, 106 bp, Homo sapiens
  chr7:155260785-155260891
  hyper
cctcagcctggaaggcgtcccagagaggccccacccccagcctccacggagacccaggagggaagaagagccgggacccggtagccctgaggggctgccgggcctg

SEQ ID NO: 3161 - DNA, 140 bp, Homo sapiens
  chr7:155261070-155261210
  hyper
cgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcc

SEQ ID NO: 3162 - DNA, 197 bp, Homo sapiens; identical to SEQ ID NO: 740
  chr7:155301753-155301950
  hyper

SEQ ID NO: 3163 - DNA, 346 bp, Homo sapiens; identical to SEQ ID NO: 741
  chr7:155302372-155302718
  hyper

SEQ ID NO: 3164 - DNA, 188 bp, Homo sapiens; identical to SEQ ID NO: 742
  chr7:155302963-155303151
  hyper

SEQ ID NO: 3165 - DNA, 372 bp, Homo sapiens
  chr7:155326169-155326541
  hyper
gcctcagaatgacagcgaggtgcacgctccggcccgcgcagagcggggccagctccgccacccagcgcgcgggaagccccgcagcaccagcagggcccgtcgcttcgctccgtcccggtccggcgtgaaacccccgaggggaaaagcgggtatcaaatgtgaattccactcgtccacagcgccgggcgttatgaaaatctgagcacctttgaccggagaagcaatagctatgggattaaggcgaatttcttacggagaggagaaagatgtgcagtttgtaattacctgctccctgtagtacagtccgtccttcacgcctggatctaacgggacaaactctcagcggctttgctctcccggcattgtttcagc

SEQ ID NO: 3166 - DNA, 21 bp, Homo sapiens
  chr7:156794464-156794485
  hyper
ccactgcgcccagcctgattt

SEQ ID NO: 3167 - DNA, 288 bp, Homo sapiens; identical to SEQ ID NO: 744
  chr7:156795067-156795355
  hyper

SEQ ID NO: 3168 - DNA, 235 bp, Homo sapiens; identical to SEQ ID NO: 745
  chr7:156795401-156795636
  hyper

SEQ ID NO: 3169 - DNA, 114 bp, Homo sapiens; identical to SEQ ID NO: 746
  chr7:156795899-156796013
  hyper

SEQ ID NO: 3170 - DNA, 246 bp, Homo sapiens; identical to SEQ ID NO: 747
  chr7:156796494-156796740
  hyper

SEQ ID NO: 3171 - DNA, 355 bp, Homo sapiens; identical to SEQ ID NO: 748
  chr7:156797005-156797360
  hyper

SEQ ID NO: 3172 - DNA, 828 bp, Homo sapiens; identical to SEQ ID NO: 749
  chr7:156797607-156798435
  hyper

SEQ ID NO: 3173 - DNA, 621 bp, Homo sapiens; identical to SEQ ID NO: 750
  chr7:156798526-156799147
  hyper

SEQ ID NO: 3174 - DNA, 50 bp, Homo sapiens; identical to SEQ ID NO: 751
  chr7:156799290-156799340
  hyper

SEQ ID NO: 3175 - DNA, 434 bp, Homo sapiens; identical to SEQ ID NO: 752
  chr7:156801438-156801872
  hyper

SEQ ID NO: 3176 - DNA, 31 bp, Homo sapiens; identical to SEQ ID NO: 753
  chr7:156810491-156810522
  hyper

SEQ ID NO: 3177 - DNA, 204 bp, Homo sapiens; identical to SEQ ID NO: 754
  chr7:156810597-156810801
  hyper

SEQ ID NO: 3178 - DNA, 104 bp, Homo sapiens; identical to SEQ ID NO: 755
  chr7:156811302-156811406
  hyper

SEQ ID NO: 3179 - DNA, 974 bp, Homo sapiens; identical to SEQ ID NO: 756
  chr7:156812852-156813826
  hyper

SEQ ID NO: 3180 - DNA, 244 bp, Homo sapiens; identical to SEQ ID NO: 757
  chr7:156813986-156814230
  hyper

SEQ ID NO: 3181 - DNA, 11 bp, Homo sapiens
  chr7:156871282-156871293
  hyper
cgagctccaga

SEQ ID NO: 3182 - DNA, 16 bp, Homo sapiens
  chr7:157477473-157477489
  hyper
gggccggggtctcctc

SEQ ID NO: 3183 - DNA, 107 bp, Homo sapiens; identical to SEQ ID NO: 759
  chr7:157477710-157477817
  hyper

SEQ ID NO: 3184 - DNA, 227 bp, Homo sapiens
  chr7:157481847-157482074
  hyper
cactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccc

SEQ ID NO: 3185 - DNA, 239 bp, Homo sapiens
  chr7:157483274-157483513
  hyper
gggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagc

SEQ ID NO: 3186 - DNA, 99 bp, Homo sapiens
  chr7:157485503-157485602
  hyper
gcccagggcaaggcccgcaaaaacccccgcaccctggctcgggggcggcgcggcggcgggcaggtcagagagaagcggtactcgggttcccccagcgcc

SEQ ID NO: 3187 - DNA, 15 bp, Homo sapiens
  chr7:157485649-157485664
  hyper
cggttcctgtccctc

SEQ ID NO: 3188 - DNA, 68 bp, Homo sapiens
  chr7:157486014-157486082
  hyper
agaaccctagggtggcgacagagcaaacccctccaggactggaggcccgacctccgcggtgctgggag

SEQ ID NO: 3189 - DNA, 211 bp, Homo sapiens
  chr7:157486204-157486415
  hyper
cggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctgg

SEQ ID NO: 3190 - DNA, 28 bp, Homo sapiens
  chr7:157486475-157486503
  hyper
cgccctggatcgccggagcctcatccag

SEQ ID NO: 3191 - DNA, 129 bp, Homo sapiens
  chr7:158937202-158937331
  hyper
cgagtcccgcaacccggcgggaccggagctcagcgcttcacgctctccgggaggaagctccggaccccgggcgaccccgctccctctcccggaccccgcccgcgctccagcacccgggaggaaggcgaa

SEQ ID NO: 3192 - DNA, 56 bp, Homo sapiens
  chr8:687162-687218
  hyper
gggggaggttctgcctccagcacccaagcggcggccgcacctcgcagtgagaccct

SEQ ID NO: 3193 - DNA, 129 bp, Homo sapiens
  chr8:687513-687642
  hyper
gggctgcccgcgcgctccccaagccgggcccttccccagatgcagccgcgcgccggccgccccccagtgcgccggtgcctccctgggcgccgagtgcgcaggcgccggccgtgaagaccgaccgtgcgc

SEQ ID NO: 3194 - DNA, 139 bp, Homo sapiens
  chr8:687837-687976
  hyper
gggggctgccgggagccgggcgcggggctccgagagccgtcgaggcggggagggcgcggtgtgtcggacccgcggggacgccccgagggcgtcagggttgggggcgggggcgagcgggggtcgtgccgcccgccggggc

SEQ ID NO: 3195 - DNA, 104 bp, Homo sapiens
  chr8:9762586-9762690
  hyper
agaccccaacaaccccgacccctctcctacgtagacactgtgaaagcaagccacagggacaaataaaagacaatccgaataccctcagcgttccgcacgccggg

SEQ ID NO: 3196 - DNA, 540 bp, Homo sapiens
  chr8:9762751-9763291
  hyper
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaa

SEQ ID NO: 3197 - DNA, 197 bp, Homo sapiens
  chr8:9763565-9763762
  hyper
agaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 3198 - DNA, 263 bp, Homo sapiens
  chr8:9763787-9764050
  hyper
cgcttccgtttatccgtttctatcccgggaaaagggggcgcctgcccgagcccacgcgcgccgccgcatctgcagcggtcggcgccccacgctccctgaacgccccccaggcggcaccagtgccgggcagagtcccctcggcggccgcgggcgtcaaatcgacacctgactccacagctcccttccctctcctcttcttccacctccccgggggtccaggcaccgccgtgcgtccactcccggtctccacggcttaggcagac

SEQ ID NO: 3199 - DNA, 718 bp, Homo sapiens
  chr8:9764195-9764913
  hyper
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagca

SEQ ID NO: 3200 - DNA, 141 bp, Homo sapiens
  chr8:11560711-11560852
  hyper
agcgtgagagccacccgccggctgttatctggggctgaaggctgcggtaatcgatgggttatttttacgcggtaatagggccctgtgattgctctattaacctttagacctgtctgagggactctccggctcgcagccccg

SEQ ID NO: 3201 - DNA, 282 bp, Homo sapiens
  chr8:11561442-11561724
  hyper
ccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggc

SEQ ID NO: 3202 - DNA, 471 bp, Homo sapiens
  chr8:11561725-11562196
  hyper
gccggcgcaggggccgcgagaggcttcgtcgccgctgcagctccgggggctcccaggggagcgtgcgcggaacctccaggcccagcaggtagggcttttttcttccctttctttgctccttcccgcggtcccccaaactcggagcttctccgcctttgcttgtctggaggtagagaggtagctagtgggaggaaaagagacgtgcgctactcacttcaccgaaattgcccaacccctgctctgcttttgactttgccttagcaacttctttaagtcaaagtaagacttgggggcaaaacagagaaatattggaagcgcctttggattctttccgtgtgaacttgaacgctttcaatccctgtccccgtgtgcacattctccaacccttgtttgcatatcgcaggccggggcctgggtggtgatggtggccgcgtgaagttaccgggactgacgggcccgggacaggctgca

SEQ ID NO: 3203 - DNA, 146 bp, Homo sapiens
  chr8:11562235-11562381
  hyper
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccct

SEQ ID NO: 3204 - DNA, 104 bp, Homo sapiens
  chr8:11562627-11562731
  hyper
tggctggggaaagagcgtggtgggggacccgcggccgatggaatccctggggcagcgcggcccgcaccgtggaggttggggaagcgcctcggggaagtgtttcc

SEQ ID NO: 3205 - DNA, 50 bp, Homo sapiens; identical to SEQ ID NO: 760
  chr8:23559552-23559602
  hyper

SEQ ID NO: 3206 - DNA, 972 bp, Homo sapiens; identical to SEQ ID NO: 761
  chr8:23559665-23560637
  hyper

SEQ ID NO: 3207 - DNA, 230 bp, Homo sapiens; identical to SEQ ID NO: 762
  chr8:23564830-23565060
  hyper

SEQ ID NO: 3208 - DNA, 15 bp, Homo sapiens
  chr8:23566840-23566855
  hyper
aacttagaatatttc

SEQ ID NO: 3209 - DNA, 15 bp, Homo sapiens
  chr8:23566900-23566915
  hyper
cgctgggttctcgcc

SEQ ID NO: 3210 - DNA, 54 bp, Homo sapiens
  chr8:23567116-23567170
  hyper
cttcctggcttgctgcgaggatgaaatgagatttttgtacgtgaaaatgctttc

SEQ ID NO: 3211 - DNA, 292 bp, Homo sapiens; identical to SEQ ID NO: 763
  chr8:23571681-23571973
  hyper

SEQ ID NO: 3212 - DNA, 85 bp, Homo sapiens
  chr8:23572524-23572609
  hyper
tgcgtccccagaccccgagaggggagttgcacacacattgctgaccttgagggtcagacagaccctttctcgtctagtttttagc

SEQ ID NO: 3213 - DNA, 46 bp, Homo sapiens
  chr8:23583971-23584017
  hyper
tacctcttattgcagcggggatactaaggccgggacaacaaaagta

SEQ ID NO: 3214 - DNA, 308 bp, Homo sapiens
  chr8:23584093-23584401
  hyper
cgcccggctgcatcctccacccggccggtttctagaaataggagataccgagaagttagggtggcccaggtctggccttagatctgcagaggggcgagtgcagattgcgcgatggcgaggctcctgcgacaaggcgaacaccaaggacgcgagctatctggaaccacaaataaaacaaattcagggacggcgttgacaccgcggccacctcctaggcgcttcttggaagggcgcggctgtggtgcccgctctgcccgtggtcccgcttacttttggactctgtcccccatggggctggggtccgggtc

SEQ ID NO: 3215 - DNA, 193 bp, Homo sapiens
  chr8:23584581-23584774
  hyper
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagca

SEQ ID NO: 3216 - DNA, 213 bp, Homo sapiens
  chr8:24770912-24771125
  hyper
gaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggc

SEQ ID NO: 3217 - DNA, 213 bp, Homo sapiens
  chr8:24771349-24771562
  hyper
ggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacg

SEQ ID NO: 3218 - DNA, 276 bp, Homo sapiens
  chr8:24813188-24813464
  hyper
tgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 3219 - DNA, 276 bp, Homo sapiens
  chr8:24813618-24813894
  hyper
cgcccggaagcgggatggctcggagtgcttctggcgcagcaccagcagctcggcttccaggaccttgttctgctgctccagctcgtgcacgcgctcgatgaagctggcgaagcggtcattgaggtcctggagctgcgccttctcctgcgtgcggatggacttgaggtcgttgctgatggcggctacctggctcaggtcgaggttctccagactgggcatcaacgatccagagctggaggagtagctgcggcgcacggacagcgaggaagacaccgg

SEQ ID NO: 3220 - DNA, 418 bp, Homo sapiens
  chr8:24814010-24814428
  hyper
cgtagctgaaggaactcatggtggcggccggtggctccccggcccgcggcggcggtgggagcccggagagagaggacaggggagagagggaagggggaggatggatggctgtgtgcggctcggcgccgttctgccacccctatttatacgccgggaggctcctgacgcagcctgcgatcgatcacggcacgccggccagtgggggcagcgcgctgctgcagccaaggcgaggattctgcgcaaaagggaaggcggggtcgagctacggcccgaggagctgcggcggtcgtcctttccactttgctcagagggccctgattttctctgagatcccatgccccctcactcatttcccttctgtactcactcacgcagcccctcccgtcctgcattgcccagaccccgtgacacttggatc

SEQ ID NO: 3221 - DNA, 514 bp, Homo sapiens; identical to SEQ ID NO: 764
  chr8:24858647-24859161
  hyper

SEQ ID NO: 3222 - DNA, 276 bp, Homo sapiens
  chr8:25900417-25900693
  hyper
acagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggt

SEQ ID NO: 3223 - DNA, 237 bp, Homo sapiens
  chr8:25900780-25901017
  hyper
cggcgctggggtctcccaggttgaaccccggtgcgcaagcaccttcattcactcttttgaaaggggtaacattttggctaagctctcccccactaagtctgctccttccagcttcaacaaactttttgatcccgggaaggaaggaaagcgagggaggcgtctttaaggagcccagctaaggaaatgcgcggcacagttggctctgcggtgctgccttatttcccttagctcgcaggc

SEQ ID NO: 3224 - DNA, 178 bp, Homo sapiens
  chr8:25901018-25901196
  hyper
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggac

SEQ ID NO: 3225 - DNA, 193 bp, Homo sapiens; identical to SEQ ID NO: 765
  chr8:37655798-37655991
  hyper

SEQ ID NO: 3226 - DNA, 148 bp, Homo sapiens; identical to SEQ ID NO: 766
  chr8:37656049-37656197
  hyper

SEQ ID NO: 3227 - DNA, 415 bp, Homo sapiens; identical to SEQ ID NO: 767
  chr8:37822994-37823409
  hyper

SEQ ID NO: 3228 - DNA, 13 bp, Homo sapiens
  chr8:37823410-37823423
  hyper
ggttggagtggca

SEQ ID NO: 3229 - DNA, 389 bp, Homo sapiens; identical to SEQ ID NO: 769
  chr8:38008209-38008598
  hyper

SEQ ID NO: 3230 - DNA, 26 bp, Homo sapiens
  chr8:41165893-41165919
  hyper
cagagctgccgctcccgggccagccc

SEQ ID NO: 3231 - DNA, 152 bp, Homo sapiens
  chr8:41166000-41166152
  hyper
cgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggctt

SEQ ID NO: 3232 - DNA, 414 bp, Homo sapiens
  chr8:41166266-41166680
  hyper
cgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgc

SEQ ID NO: 3233 - DNA, 244 bp, Homo sapiens
  chr8:41166745-41166989
  hyper
cgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtg

SEQ ID NO: 3234 - DNA, 98 bp, Homo sapiens
  chr8:41167025-41167123
  hyper
cgcgcagccaatcagctcccggcggggcgagccgcactcgttaccacgtccgtcaccggcgcgggagccaatcgcctccctcgcgagcgggttcggtt

SEQ ID NO: 3235 - DNA, 428 bp, Homo sapiens
  chr8:41753325-41753753
  hyper
ggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgc

SEQ ID NO: 3236 - DNA, 411 bp, Homo sapiens
  chr8:41753770-41754181
  hyper
cgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcgggaaggcgaaggcagttccggacgcggagggc

SEQ ID NO: 3237 - DNA, 1026 bp, Homo sapiens
  chr8:41754182-41755208
  hyper
aggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctc

SEQ ID NO: 3238 - DNA, 140 bp, Homo sapiens
  chr8:49293385-49293525
  hyper
gggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctg

SEQ ID NO: 3239 - DNA, 37 bp, Homo sapiens
  chr8:49293580-49293617
  hyper
cgccaaaaagagctttgcccgccgggtgatggagatc

SEQ ID NO: 3240 - DNA, 160 bp, Homo sapiens; identical to SEQ ID NO: 770
  chr8:49468668-49468828
  hyper

SEQ ID NO: 3241 - DNA, 362 bp, Homo sapiens; identical to SEQ ID NO: 771
  chr8:49468829-49469191
  hyper

SEQ ID NO: 3242 - DNA, 288 bp, Homo sapiens
  chr8:53477449-53477737
  hyper
gtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 3243 - DNA, 150 bp, Homo sapiens
  chr8:53478480-53478630
  hyper
caggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgccc

SEQ ID NO: 3244 - DNA, 123 bp, Homo sapiens
  chr8:53854249-53854372
  hyper
tttccctttcctatccgtgatctcccctgaaaatgtcagactcccggagcaaggaacccggagtagcccgggcgcgcggttccggcgccccctggaggagccagcggccgagtgcttagcgtc

SEQ ID NO: 3245 - DNA, 193 bp, Homo sapiens; identical to SEQ ID NO: 772
  chr8:54789613-54789806
  hyper

SEQ ID NO: 3246 - DNA, 588 bp, Homo sapiens; identical to SEQ ID NO: 773
  chr8:54790022-54790610
  hyper

SEQ ID NO: 3247 - DNA, 49 bp, Homo sapiens; identical to SEQ ID NO: 774
  chr8:54791897-54791946
  hyper

SEQ ID NO: 3248 - DNA, 487 bp, Homo sapiens; identical to SEQ ID NO: 775
  chr8:54792184-54792671
  hyper

SEQ ID NO: 3249 - DNA, 427 bp, Homo sapiens; identical to SEQ ID NO: 776
  chr8:54792701-54793128
  hyper

SEQ ID NO: 3250 - DNA, 203 bp, Homo sapiens
  chr8:55366165-55366368
  hyper
aagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 3251 - DNA, 562 bp, Homo sapiens
  chr8:55367063-55367625
  hyper
aacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaa

SEQ ID NO: 3252 - DNA, 223 bp, Homo sapiens; identical to SEQ ID NO: 777
  chr8:55370113-55370336
  hyper

SEQ ID NO: 3253 - DNA, 86 bp, Homo sapiens; identical to SEQ ID NO: 778
  chr8:55370337-55370423
  hyper

SEQ ID NO: 3254 - DNA, 9 bp, Homo sapiens
  chr8:55370424-55370433
  hyper
ggaccggcc

SEQ ID NO: 3255 - DNA, 109 bp, Homo sapiens; identical to SEQ ID NO: 780
  chr8:55370567-55370676
  hyper

SEQ ID NO: 3256 - DNA, 204 bp, Homo sapiens; identical to SEQ ID NO: 781
  chr8:55371172-55371376
  hyper

SEQ ID NO: 3257 - DNA, 286 bp, Homo sapiens; identical to SEQ ID NO: 782
  chr8:55371439-55371725
  hyper

SEQ ID NO: 3258 - DNA, 75 bp, Homo sapiens; identical to SEQ ID NO: 783
  chr8:55371993-55372068
  hyper

SEQ ID NO: 3259 - DNA, 60 bp, Homo sapiens; identical to SEQ ID NO: 784
  chr8:55372416-55372476
  hyper

SEQ ID NO: 3260 - DNA, 29 bp, Homo sapiens
  chr8:55379202-55379231
  hyper
ctcttagcttggtgccggggcccgcccgg

SEQ ID NO: 3261 - DNA, 162 bp, Homo sapiens
  chr8:55379295-55379457
  hyper
cgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgc

SEQ ID NO: 3262 - DNA, 108 bp, Homo sapiens
  chr8:55380036-55380144
  hyper
cgccgggggaggcggagcgcggggaacccgggcgccgggaaccccggacgtgggagggctgggcttctgcgcggggagacgccgggcttggcgaacatcctcaagaac

SEQ ID NO: 3263 - DNA, 54 bp, Homo sapiens
  chr8:56014131-56014185
  hyper
ccgagcccgggcgcccgagttacacccattctccccaccatcgtcggccagagc

SEQ ID NO: 3264 - DNA, 368 bp, Homo sapiens
  chr8:56014376-56014744
  hyper
cgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagaggaagcgggaggagggagcgcgcgcgaggggaggagaggaatgtgcaggtccgaggagcgccgcggcggccgctgctgctcctgctgctggcggcggcggcggctcgggcggcagcagcgaagc

SEQ ID NO: 3265 - DNA, 19 bp, Homo sapiens
  chr8:56015034-56015053
  hyper
ggtgtggaggcatcatggc

SEQ ID NO: 3266 - DNA, 161 bp, Homo sapiens; identical to SEQ ID NO: 786
  chr8:56015185-56015346
  hyper

SEQ ID NO: 3267 - DNA, 67 bp, Homo sapiens; identical to SEQ ID NO: 787
  chr8:56015565-56015632
  hyper

SEQ ID NO: 3268 - DNA, 181 bp, Homo sapiens
  chr8:57026141-57026322
  hyper
ggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacac

SEQ ID NO: 3269 - DNA, 55 bp, Homo sapiens
  chr8:57026501-57026556
  hyper
cgctccggaggtaggggcgtagggccaggggcgagggcatcgcactttgcagggg

SEQ ID NO: 3270 - DNA, 148 bp, Homo sapiens; identical to SEQ ID NO: 788
  chr8:57069590-57069738
  hyper

SEQ ID NO: 3271 - DNA, 163 bp, Homo sapiens; identical to SEQ ID NO: 789
  chr8:57069850-57070013
  hyper

SEQ ID NO: 3272 - DNA, 143 bp, Homo sapiens; identical to SEQ ID NO: 790
  chr8:57070014-57070157
  hyper

SEQ ID NO: 3273 - DNA, 286 bp, Homo sapiens; identical to SEQ ID NO: 791
  chr8:57358806-57359092
  hyper

SEQ ID NO: 3274 - DNA, 400 bp, Homo sapiens; identical to SEQ ID NO: 792
  chr8:57359259-57359659
  hyper

SEQ ID NO: 3275 - DNA, 86 bp, Homo sapiens; identical to SEQ ID NO: 793
  chr8:57360540-57360626
  hyper

SEQ ID NO: 3276 - DNA, 37 bp, Homo sapiens; identical to SEQ ID NO: 794
  chr8:57360769-57360806
  hyper

SEQ ID NO: 3277 - DNA, 109 bp, Homo sapiens
  chr8:65282332-65282441
  hyper
cggtgggggcagcggggcgaggcgaggtcgcagggagacgaccaggcctgcttgggcctgggccgctccagccgcctcgcctcttcagggacctcgccccgggaccacc

SEQ ID NO: 3278 - DNA, 170 bp, Homo sapiens
  chr8:65286942-65287112
  hyper
agaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaag

SEQ ID NO: 3279 - DNA, 724 bp, Homo sapiens
  chr8:65289592-65290316
  hyper
gagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctct

SEQ ID NO: 3280 - DNA, 51 bp, Homo sapiens
  chr8:65488271-65488322
  hyper
cttgtgtgtgcacctcgcgctgagaaggctgcctcccggggctcagggttt

SEQ ID NO: 3281 - DNA, 84 bp, Homo sapiens
  chr8:65492776-65492860
  hyper
aactattcagacttgcggccagatagcgcctgcgattgtttgttaccgttttaatcctattaattaaaacgttaacctgattgg

SEQ ID NO: 3282 - DNA, 384 bp, Homo sapiens
  chr8:65493195-65493579
  hyper
aggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 3283 - DNA, 149 bp, Homo sapiens
  chr8:65493806-65493955
  hyper
ggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcgg

SEQ ID NO: 3284 - DNA, 25 bp, Homo sapiens
  chr8:65494076-65494101
  hyper
cggcttaacatcaatgcccgagagc

SEQ ID NO: 3285 - DNA, 91 bp, Homo sapiens
  chr8:65494102-65494193
  hyper
ccggcggatgcacgacctgaacgacgcgctggacgagctgcgcgcggtgatcccctacgcgcacagcccctcggtgcgaaagctctccaag

SEQ ID NO: 3286 - DNA, 173 bp, Homo sapiens
  chr8:65499750-65499923
  hyper
tccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttca

SEQ ID NO: 3287 - DNA, 95 bp, Homo sapiens; identical to SEQ ID NO: 795
  chr8:67873327-67873422
  hyper

SEQ ID NO: 3288 - DNA, 1 bp, Homo sapiens
  chr8:67873798-67873799
  hyper
c

SEQ ID NO: 3289 - DNA, 251 bp, Homo sapiens; identical to SEQ ID NO: 797
  chr8:67873800-67874051
  hyper

SEQ ID NO: 3290 - DNA, 509 bp, Homo sapiens; identical to SEQ ID NO: 798
  chr8:67874164-67874673
  hyper

SEQ ID NO: 3291 - DNA, 103 bp, Homo sapiens; identical to SEQ ID NO: 799
  chr8:67874755-67874858
  hyper

SEQ ID NO: 3292 - DNA, 402 bp, Homo sapiens; identical to SEQ ID NO: 800
  chr8:67874859-67875261
  hyper

SEQ ID NO: 3293 - DNA, 179 bp, Homo sapiens; identical to SEQ ID NO: 801
  chr8:67875262-67875441
  hyper

SEQ ID NO: 3294 - DNA, 240 bp, Homo sapiens; identical to SEQ ID NO: 802
  chr8:67875442-67875682
  hyper

SEQ ID NO: 3295 - DNA, 159 bp, Homo sapiens
  chr8:67940805-67940964
  hyper
tgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgt

SEQ ID NO: 3296 - DNA, 258 bp, Homo sapiens
  chr8:68864545-68864803
  hyper
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtcc

SEQ ID NO: 3297 - DNA, 202 bp, Homo sapiens
  chr8:69243284-69243486
  hyper
cggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttc

SEQ ID NO: 3298 - DNA, 329 bp, Homo sapiens
  chr8:69243487-69243816
  hyper
cggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcc

SEQ ID NO: 3299 - DNA, 71 bp, Homo sapiens
  chr8:70946844-70946915
  hyper
atccactctccctttcgcctccctagaggttgtcaggttcaagaagcggcccggagttgcaggaagggcgc

SEQ ID NO: 3300 - DNA, 568 bp, Homo sapiens
  chr8:70947090-70947658
  hyper
ggcgtccatgtgttctgcaccccttctcgcccggtgcctctctcaaggcacgttttccaaagtgtgttgaattcgggaatcgatcgaaaatttcaaggccaattaaatgccctctgatgtagagctccgattaggcccgaaaggcttcaaacagcccctctagaccctcgagggtcttcgccgcggtaaccttaggcgtcccctccccgagaagtctccctgaggctttcacagagggcgggaggggctgcgctggggcctccgttcccagtgcccctgactggtggggagggatggccttagtgtctgagagcagagaccagattgactcccacttgagaccagaaaacgaagaggaagcggaacccgaggtggctgcggctcccccgggacacaaccgggagaggaagtcctggccatctgccggccccgcctgggggcatctgctcgaggatccctgggagccgttatcgtattcctcagaatctgccgtgctgtccctccgcccccaaaaccaacaggacacccattctgtgattctcttcttctccatcgcccagttggaggc

SEQ ID NO: 3301 - DNA, 23 bp, Homo sapiens
  chr8:70982262-70982285
  hyper
cgctcccacaattaagacaaaac

SEQ ID NO: 3302 - DNA, 281 bp, Homo sapiens; identical to SEQ ID NO: 804
  chr8:70982286-70982567
  hyper

SEQ ID NO: 3303 - DNA, 397 bp, Homo sapiens; identical to SEQ ID NO: 805
  chr8:70982850-70983247
  hyper

SEQ ID NO: 3304 - DNA, 302 bp, Homo sapiens; identical to SEQ ID NO: 806
  chr8:70983568-70983870
  hyper

SEQ ID NO: 3305 - DNA, 277 bp, Homo sapiens; identical to SEQ ID NO: 807
  chr8:70984016-70984293
  hyper

SEQ ID NO: 3306 - DNA, 319 bp, Homo sapiens; identical to SEQ ID NO: 808
  chr8:70984343-70984662
  hyper

SEQ ID NO: 3307 - DNA, 250 bp, Homo sapiens; identical to SEQ ID NO: 809
  chr8:70984744-70984994
  hyper

SEQ ID NO: 3308 - DNA, 78 bp, Homo sapiens; identical to SEQ ID NO: 810
  chr8:72460433-72460511
  hyper

SEQ ID NO: 3309 - DNA, 557 bp, Homo sapiens
  chr8:72468582-72469139
  hyper
tgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctg

SEQ ID NO: 3310 - DNA, 345 bp, Homo sapiens; identical to SEQ ID NO: 811
  chr8:72755470-72755815
  hyper

SEQ ID NO: 3311 - DNA, 157 bp, Homo sapiens; identical to SEQ ID NO: 812
  chr8:72756655-72756812
  hyper

SEQ ID NO: 3312 - DNA, 83 bp, Homo sapiens; identical to SEQ ID NO: 813
  chr8:72756813-72756896
  hyper

SEQ ID NO: 3313 - DNA, 316 bp, Homo sapiens
  chr8:72987600-72987916
  hyper
ttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggc

SEQ ID NO: 3314 - DNA, 119 bp, Homo sapiens
  chr8:72987917-72988036
  hyper
gcgccgcgtctgccttggactcgccccttcagggacaaagtgactcgcccgtcccgctgtcctgcagctgcagcagcgcactgacggagtcaagcgtgtcaggtcggggtggattgcag

SEQ ID NO: 3315 - DNA, 153 bp, Homo sapiens
  chr8:73449802-73449955
  hyper
gaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 3316 - DNA, 90 bp, Homo sapiens
  chr8:73450026-73450116
  hyper
cggggagaggctccccggagggagcggggaatcccacagccctttgtggtgcccgagcccgtgccgcctgctgagcggggtctgtgggag

SEQ ID NO: 3317 - DNA, 262 bp, Homo sapiens
  chr8:75896574-75896836
  hyper
gccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtcccc

SEQ ID NO: 3318 - DNA, 364 bp, Homo sapiens
  chr8:75896837-75897201
  hyper
cccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccacc

SEQ ID NO: 3319 - DNA, 156 bp, Homo sapiens
  chr8:77585219-77585375
  hyper
agcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtga

SEQ ID NO: 3320 - DNA, 165 bp, Homo sapiens
  chr8:77586175-77586340
  hyper
agttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggca

SEQ ID NO: 3321 - DNA, 293 bp, Homo sapiens
  chr8:77590239-77590532
  hyper
agtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctg

SEQ ID NO: 3322 - DNA, 490 bp, Homo sapiens
  chr8:80523960-80524450
  hyper
actgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagag

SEQ ID NO: 3323 - DNA, 164 bp, Homo sapiens
  chr8:80803593-80803757
  hyper
actctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggag

SEQ ID NO: 3324 - DNA, 199 bp, Homo sapiens
  chr8:81478156-81478355
  hyper
cgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaa

SEQ ID NO: 3325 - DNA, 448 bp, Homo sapiens; identical to SEQ ID NO: 814
  chr8:91997061-91997509
  hyper

SEQ ID NO: 3326 - DNA, 479 bp, Homo sapiens; identical to SEQ ID NO: 815
  chr8:91997527-91998006
  hyper

SEQ ID NO: 3327 - DNA, 202 bp, Homo sapiens; identical to SEQ ID NO: 816
  chr8:97157008-97157210
  hyper

SEQ ID NO: 3328 - DNA, 232 bp, Homo sapiens; identical to SEQ ID NO: 817
  chr8:97157666-97157898
  hyper

SEQ ID NO: 3329 - DNA, 122 bp, Homo sapiens; identical to SEQ ID NO: 818
  chr8:97158021-97158143
  hyper

SEQ ID NO: 3330 - DNA, 204 bp, Homo sapiens; identical to SEQ ID NO: 819
  chr8:97169716-97169920
  hyper

SEQ ID NO: 3331 - DNA, 13 bp, Homo sapiens
  chr8:97169921-97169934
  hyper
gaagtccttgcca

SEQ ID NO: 3332 - DNA, 180 bp, Homo sapiens; identical to SEQ ID NO: 821
  chr8:97170158-97170338
  hyper

SEQ ID NO: 3333 - DNA, 291 bp, Homo sapiens; identical to SEQ ID NO: 822
  chr8:97170377-97170668
  hyper

SEQ ID NO: 3334 - DNA, 65 bp, Homo sapiens
  chr8:97171119-97171184
  hyper
gaacctcgctgacctcgggctgcagcggcgagaccctcgagcaaggaacgcgactatgagtgaga

SEQ ID NO: 3335 - DNA, 361 bp, Homo sapiens; identical to SEQ ID NO: 823
  chr8:97171598-97171959
  hyper

SEQ ID NO: 3336 - DNA, 722 bp, Homo sapiens; identical to SEQ ID NO: 824
  chr8:97172018-97172740
  hyper

SEQ ID NO: 3337 - DNA, 50 bp, Homo sapiens; identical to SEQ ID NO: 825
  chr8:97172821-97172871
  hyper

SEQ ID NO: 3338 - DNA, 388 bp, Homo sapiens; identical to SEQ ID NO: 826
  chr8:97173138-97173526
  hyper

SEQ ID NO: 3339 - DNA, 13 bp, Homo sapiens
  chr8:97173527-97173540
  hyper
gtggtaccctccc

SEQ ID NO: 3340 - DNA, 231 bp, Homo sapiens
  chr8:97506177-97506408
  hyper
cgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggatt

SEQ ID NO: 3341 - DNA, 38 bp, Homo sapiens
  chr8:97506447-97506485
  hyper
cgttttgccctggttgcaagcagcggctgggagcagcc

SEQ ID NO: 3342 - DNA, 580 bp, Homo sapiens
  chr8:97507115-97507695
  hyper
gtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaag

SEQ ID NO: 3343 - DNA, 50 bp, Homo sapiens; identical to SEQ ID NO: 828
  chr8:98289818-98289868
  hyper

SEQ ID NO: 3344 - DNA, 425 bp, Homo sapiens; identical to SEQ ID NO: 829
  chr8:98289922-98290347
  hyper

SEQ ID NO: 3345 - DNA, 660 bp, Homo sapiens; identical to SEQ ID NO: 830
  chr8:99439694-99440354
  hyper

SEQ ID NO: 3346 - DNA, 298 bp, Homo sapiens; identical to SEQ ID NO: 831
  chr8:99951846-99952144
  hyper

SEQ ID NO: 3347 - DNA, 106 bp, Homo sapiens; identical to SEQ ID NO: 832
  chr8:99952198-99952304
  hyper

SEQ ID NO: 3348 - DNA, 319 bp, Homo sapiens; identical to SEQ ID NO: 833
  chr8:99952532-99952851
  hyper

SEQ ID NO: 3349 - DNA, 178 bp, Homo sapiens; identical to SEQ ID NO: 834
  chr8:99985866-99986044
  hyper

SEQ ID NO: 3350 - DNA, 302 bp, Homo sapiens; identical to SEQ ID NO: 835
  chr8:99986225-99986527
  hyper

SEQ ID NO: 3351 - DNA, 165 bp, Homo sapiens; identical to SEQ ID NO: 836
  chr8:99986791-99986956
  hyper

SEQ ID NO: 3352 - DNA, 133 bp, Homo sapiens
  chr8:101821973-101822106
  hyper
tgattggtgcagagacgctgtaaacgcacctttgcggaacacagacgacacaggaaagacgtttggcagtaatactacgacagcgaggggcccgggaagcccgcggaaacgcaggaggcggccaggagaggca

SEQ ID NO: 3353 - DNA, 930 bp, Homo sapiens
  chr8:104512023-104512953
  hyper
gggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctcccc

SEQ ID NO: 3354 - DNA, 504 bp, Homo sapiens
  chr8:104513405-104513909
  hyper
aggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 3355 - DNA, 16 bp, Homo sapiens
  chr8:104513910-104513926
  hyper
gcgagtgctaacaccc

SEQ ID NO: 3356 - DNA, 253 bp, Homo sapiens
  chr8:105235249-105235502
  hyper
cctgtgtttgaggagcgttaaaaaaaactgtgaacctgaggaaagggaaagtgactaccagaaatttaccggtttacttatctgagatgcctaactcactgcatctaattagtcaccactccctggccttaaccacgcggagggaagaggaaacagcaggagctactcggagcagctgcccgggacctgaggcgcgcgccccggagccaccagcccaccgaggtgcagccgcgccgccacctccccctccggc

SEQ ID NO: 3357 - DNA, 952 bp, Homo sapiens
  chr8:109094485-109095437
  hyper
cggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtct

SEQ ID NO: 3358 - DNA, 2 bp, Homo sapiens
  chr8:109095505-109095507
  hyper
cg

SEQ ID NO: 3359 - DNA, 117 bp, Homo sapiens
  chr8:110703765-110703882
  hyper
gcgctccggtgccctcggcccctcggcctctgcagccagccgggcggctgctggggctgaggacaaaatggagagaagggcgggggaccaaagggcaggcaccgctgggtggggcgc

SEQ ID NO: 3360 - DNA, 408 bp, Homo sapiens; identical to SEQ ID NO: 837
  chr8:114444784-114445192
  hyper

SEQ ID NO: 3361 - DNA, 179 bp, Homo sapiens
  chr8:114446958-114447137
  hyper
tccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggc

SEQ ID NO: 3362 - DNA, 23 bp, Homo sapiens
  chr8:116660615-116660638
  hyper
cgataacacgcccacagcccggg

SEQ ID NO: 3363 - DNA, 139 bp, Homo sapiens
  chr8:117950379-117950518
  hyper
tccttgaattacctccgcccccgccctgaccccgccctaaacatcaaacttagaaactcatctttcagcagcagcggtagagcagtgaccaggcgtctccgcgatgggccccggggacttccgccgctgcagagagaga

SEQ ID NO: 3364 - DNA, 173 bp, Homo sapiens
  chr8:117950779-117950952
  hyper
accctggccaggctgcgggcggagctggtgagagagcgggctaggcggacggctcccagggctccctctcccgggtcctctcctccagctgcagagccgctggccgcgtagcccacccgacgccttggggggcccctcaggtctggacacggcgttgacgcccccgcctcccc

SEQ ID NO: 3365 - DNA, 297 bp, Homo sapiens
  chr8:121137130-121137427
  hyper
cgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagg

SEQ ID NO: 3366 - DNA, 45 bp, Homo sapiens
  chr8:121137638-121137683
  hyper
gaaaagtggaggcagcgagccacctgcagacgcaatgcagttcca

SEQ ID NO: 3367 - DNA, 295 bp, Homo sapiens
  chr8:132052005-132052300
  hyper
tcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 3368 - DNA, 118 bp, Homo sapiens
  chr8:132052398-132052516
  hyper
cgctgccgctgcctccccggtgcccgtgaatgaagcgctgctccgtgatgtgtcgcaccgccgtctgccacagcagccgctgcggccgggaggcgctcctgccgtcgccggccggggg

SEQ ID NO: 3369 - DNA, 367 bp, Homo sapiens
  chr8:132052589-132052956
  hyper
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctct

SEQ ID NO: 3370 - DNA, 777 bp, Homo sapiens; identical to SEQ ID NO: 838
  chr8:132053807-132054584
  hyper

SEQ ID NO: 3371 - DNA, 164 bp, Homo sapiens; identical to SEQ ID NO: 839
  chr8:132054593-132054757
  hyper

SEQ ID NO: 3372 - DNA, 293 bp, Homo sapiens; identical to SEQ ID NO: 840
  chr8:140714570-140714863
  hyper

SEQ ID NO: 3373 - DNA, 5 bp, Homo sapiens
  chr8:143532505-143532510
  hyper
ggcct

SEQ ID NO: 3374 - DNA, 958 bp, Homo sapiens
  chr8:143532541-143533499
  hyper
cgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccac

SEQ ID NO: 3375 - DNA, 141 bp, Homo sapiens
  chr8:143533500-143533641
  hyper
ccctcccttcggctcgctagctgctccttggcgctgctttcagacttgttgcgcctcgatctggggggcagaaggctggcccgggagacccggcggctgagggccgagccgcgaagcccagggatgcgccagagaggcgcg

SEQ ID NO: 3376 - DNA, 343 bp, Homo sapiens
  chr8:143533708-143534051
  hyper
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcgg

SEQ ID NO: 3377 - DNA, 153 bp, Homo sapiens
  chr8:144241281-144241434
  hyper
atccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 3378 - DNA, 87 bp, Homo sapiens
  chr8:144241435-144241522
  hyper
ggagcgggtgggacctgccactggggggaggggcgcgtgccaggtccccacccccacccctgggctggggggccgggaaccccgggc

SEQ ID NO: 3379 - DNA, 292 bp, Homo sapiens
  chr8:144241871-144242163
  hyper
gcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcct

SEQ ID NO: 3380 - DNA, 317 bp, Homo sapiens
  chr8:144328254-144328571
  hyper
gacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgg

SEQ ID NO: 3381 - DNA, 933 bp, Homo sapiens
  chr8:144511184-144512117
  hyper
tctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgc

SEQ ID NO: 3382 - DNA, 84 bp, Homo sapiens; identical to SEQ ID NO: 841
  chr9:117876-117960
  hyper

SEQ ID NO: 3383 - DNA, 144 bp, Homo sapiens
  chr9:841706-841850
  hyper
cgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgac

SEQ ID NO: 3384 - DNA, 181 bp, Homo sapiens
  chr9:841851-842032
  hyper
aggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgc

SEQ ID NO: 3385 - DNA, 1 bp, Homo sapiens
  chr9:842207-842208
  hyper
c

SEQ ID NO: 3386 - DNA, 30 bp, Homo sapiens; identical to SEQ ID NO: 842
  chr9:970195-970225
  hyper

SEQ ID NO: 3387 - DNA, 414 bp, Homo sapiens; identical to SEQ ID NO: 843
  chr9:972345-972759
  hyper

SEQ ID NO: 3388 - DNA, 175 bp, Homo sapiens
  chr9:1042326-1042501
  hyper
tggaagggtctgacacggaatctgaccaaggctggaccctcaataattgtgatttcttttcccccttttccttcttggtaaaatcatcccacgaatctacgcaagtagggcccttcgtcattcttcggagtagccgcttgagggctggaaggagcagtgatagaaaccccagaga

SEQ ID NO: 3389 - DNA, 328 bp, Homo sapiens
  chr9:1042615-1042943
  hyper
cggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccg

SEQ ID NO: 3390 - DNA, 274 bp, Homo sapiens; identical to SEQ ID NO: 844
  chr9:1052044-1052318
  hyper

SEQ ID NO: 3391 - DNA, 263 bp, Homo sapiens
  chr9:6412587-6412850
  hyper
gcctccgccaggcgacgggaaaccctcggaagtgggtttccgcgcgaaagtagcattgcggccaggcgggaaacgtgttcgcgaagcaggagggcccccggggcctttcccgggcgacccgacccgccaggccgcgtggcgggagctttcctgttgagcgcggtggagcgcacacatttccttcagttctttctcggaagtttaggccgcacccacccgcgccccctttccaggattatacaagtgcacgccagggtttctta

SEQ ID NO: 3392 - DNA, 17 bp, Homo sapiens
  chr9:6644351-6644368
  hyper
aacgcaggggaagctcg

SEQ ID NO: 3393 - DNA, 268 bp, Homo sapiens; identical to SEQ ID NO: 845
  chr9:6645065-6645333
  hyper

SEQ ID NO: 3394 - DNA, 345 bp, Homo sapiens
  chr9:14348107-14348452
  hyper
gaaggaaatgtggtgcgccctctggggcgtgaggccgccgcggcccattctacacacctactggcattccgcttttccttactgtgcgccaggggaaggcataattcaattatatcatacaactgcagcgcacccttttccttttttgctttgaggggaattttccaattcccaaataaatacctatggctctaaagccgagttgggttctgtagtaactaccgggggtgaaaaaaaaaaaagaccccaaattggctgtgagtttacagcctgaagcagcttatttaggctcgctgagcgccgttccaaacggcagggctcacgctatttcgggagaagttggag

SEQ ID NO: 3395 - DNA, 22 bp, Homo sapiens
  chr9:17907450-17907472
  hyper
cggacgccggaccaggtgggct

SEQ ID NO: 3396 - DNA, 153 bp, Homo sapiens; identical to SEQ ID NO: 846
  chr9:19789107-19789260
  hyper

SEQ ID NO: 3397 - DNA, 556 bp, Homo sapiens
  chr9:21402590-21403146
  hyper
tccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 3398 - DNA, 913 bp, Homo sapiens
  chr9:21974204-21975117
  hyper
tcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 3399 - DNA, 418 bp, Homo sapiens
  chr9:21975190-21975608
  hyper
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggca

SEQ ID NO: 3400 - DNA, 93 bp, Homo sapiens; identical to SEQ ID NO: 847
  chr9:29214993-29215086
  hyper

SEQ ID NO: 3401 - DNA, 256 bp, Homo sapiens
  chr9:32782680-32782936
  hyper
aagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 3402 - DNA, 138 bp, Homo sapiens
  chr9:32783083-32783221
  hyper
cgaggggttgagagaagggcggtcggggagcccctgggcctgccgtcagtcacccggatttgtaactggagaagggtgcgggtcccggagggacatctccagctggcacctaactcctcggatcccggactgggagcc

SEQ ID NO: 3403 - DNA, 161 bp, Homo sapiens
  chr9:32783259-32783420
  hyper
cgaccctggtttccgactccggccactggcagcctcgcgccccagacccttcccgggcacggaagcgggtcaggtcgccctgctcagcctccggaacggcggcggcacaaaccccggccgctcccagcagccccgacgagaccccgggcagcgcctgccgc

SEQ ID NO: 3404 - DNA, 48 bp, Homo sapiens
  chr9:32783590-32783638
  hyper
cgccgggctccgcttgcacagcaccgggaccgacgggcactgctggga

SEQ ID NO: 3405 - DNA, 148 bp, Homo sapiens
  chr9:36739852-36740000
  hyper
gcctccgcggctgaacggacatcctgtcagacaggcctcttaatccaatcacttacctgtggaggggagccggctgcctcctcctggcccccttcctcctcccatggcacctgcggggccacgcggggtgctccggagccagggtaca

SEQ ID NO: 3406 - DNA, 6 bp, Homo sapiens
  chr9:37002512-37002518
  hyper
gcgggc

SEQ ID NO: 3407 - DNA, 171 bp, Homo sapiens
  chr9:37002818-37002989
  hyper
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaa

SEQ ID NO: 3408 - DNA, 1046 bp, Homo sapiens
  chr9:37025306-37026352
  hyper
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcagcaaacagaaaggaaacgcgattcgttccacttggaatttccttgaaatctccgaatctaatccggcgttaactcaccgtgagaggagcgctcatctcacaggaggctgtggtaatgggtgaattggcaggatccctgcgggccaggcagccaggccggccttgccctcgccctaaatgacccttcccgtctcctacacacgctgcgtctttcagaggcgggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcggagtaggggtgtggggcgctgtctgagactctgactggcctctccctacaacttactgccctccaactggcctggcccggagccctctacgggtccaagccagggttctccgaaagagctgaaatgtcgccgccggagccttgaaaggctgcagctcgctgcccaagctacgcgttgccggaggcgggattcccaggtgcctcagcc

SEQ ID NO: 3409 - DNA, 839 bp, Homo sapiens
  chr9:37026433-37027272
  hyper
cgagatccttccggccttagtacctgacccacggtccggcacccccaacccggtcccggcgggagagtgagagaagcgagctcgccgcctacttactatgcatggatgcaaacgggtcgtgcttacagtgtatttccatcggggcgctccagactgcaggccggcccacgccgccgcctcccggcgccaaggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctggctcaagcagcagctccgggcccagcccggggtagctgcggccaaggcgcccgcggcttcgggggcatagcgtaggggcccgcctccgggacagccagcagcccccggccccaggaaggagcagctttgaggaggccgccggaacaatcggcccttgacttcactcagggggcggagagacccgggggctgccaggctggttccgcggcctcgatgcttctgaggtccctcctcgacccctcggtctccgccagatcctttctttctctgcttctccgagtctctggggctcggacttgccccctccgcctctctccaactggctctccgacgtctcggacgaagttgcaaagaacttcctctccggcagcgcggggtcctggcgggtttggagatgcttccgcccctgacgctggggccgcgactccggagtccccgggag

SEQ ID NO: 3410 - DNA, 60 bp, Homo sapiens
  chr9:37027324-37027384
  hyper
cgctgctcgcccatcgctgggaccaggaacggggacaccagcgacggactcttcctcgcc

SEQ ID NO: 3411 - DNA, 444 bp, Homo sapiens
  chr9:37027385-37027829
  hyper
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaa

SEQ ID NO: 3412 - DNA, 874 bp, Homo sapiens; identical to SEQ ID NO: 848
  chr9:37029893-37030767
  hyper

SEQ ID NO: 3413 - DNA, 432 bp, Homo sapiens
  chr9:37036462-37036894
  hyper
ttaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatccccca

SEQ ID NO: 3414 - DNA, 812 bp, Homo sapiens; identical to SEQ ID NO: 849
  chr9:37037453-37038265
  hyper

SEQ ID NO: 3415 - DNA, 30 bp, Homo sapiens
  chr9:77115417-77115447
  hyper
ttgacctgggctttacggtgggcccactgc

SEQ ID NO: 3416 - DNA, 522 bp, Homo sapiens; identical to SEQ ID NO: 850
  chr9:79626876-79627398
  hyper

SEQ ID NO: 3417 - DNA, 199 bp, Homo sapiens; identical to SEQ ID NO: 851
  chr9:79629207-79629406
  hyper

SEQ ID NO: 3418 - DNA, 350 bp, Homo sapiens
  chr9:79633334-79633684
  hyper
gtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctca

SEQ ID NO: 3419 - DNA, 531 bp, Homo sapiens
  chr9:79634237-79634768
  hyper
cagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctcc

SEQ ID NO: 3420 - DNA, 400 bp, Homo sapiens
  chr9:79635049-79635449
  hyper
ccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 3421 - DNA, 131 bp, Homo sapiens; identical to SEQ ID NO: 852
  chr9:79635834-79635965
  hyper

SEQ ID NO: 3422 - DNA, 295 bp, Homo sapiens; identical to SEQ ID NO: 853
  chr9:79636258-79636553
  hyper

SEQ ID NO: 3423 - DNA, 230 bp, Homo sapiens; identical to SEQ ID NO: 854
  chr9:79637659-79637889
  hyper

SEQ ID NO: 3424 - DNA, 46 bp, Homo sapiens; identical to SEQ ID NO: 855
  chr9:79638136-79638182
  hyper

SEQ ID NO: 3425 - DNA, 107 bp, Homo sapiens
  chr9:86755532-86755639
  hyper
gctccccaggcaaagcggccccgccaggacgggcacggcttcgcgtcctcgctcaagtccccgatgatggccgcgtcccggcaggcacggtgcgaattgactggggt

SEQ ID NO: 3426 - DNA, 30 bp, Homo sapiens
  chr9:88137696-88137726
  hyper
ggaaggccaggagaacgcggttccccttct

SEQ ID NO: 3427 - DNA, 240 bp, Homo sapiens
  chr9:88137874-88138114
  hyper
cgcgcgatcgccctgtgcgcgcaggagtgacaggcgccccagctcgcgctctccagcccgccagggcccggctttggcagacccgaggctcctcacccgccctgagggacgggttgtacttactgagaactgatgcttagtaagcttaaaagccccagaaaggaagtctgtacaaatccttaatgatccagtcaattgtcgctgcataacaaaccaccccagaaccggtaacttgaaaca

SEQ ID NO: 3428 - DNA, 97 bp, Homo sapiens
  chr9:91606004-91606101
  hyper
cccaagcccagacctcggacctggttccaagcctgttcccgctgggtctctgggcgcccggtttctgcacctggagctcgcccgatgaggacaaggt

SEQ ID NO: 3429 - DNA, 120 bp, Homo sapiens
  chr9:94712294-94712414
  hyper
cggggtcgggcgccaccacccctttctacgatgcgtccgctcctccttctccctggcgcttcgcaaacgggtccacttcgaggacctcgtcgtcgtcctcttctccggcccggatgcgcc

SEQ ID NO: 3430 - DNA, 651 bp, Homo sapiens
  chr9:96710796-96711447
  hyper
gggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcc

SEQ ID NO: 3431 - DNA, 83 bp, Homo sapiens
  chr9:96711534-96711617
  hyper
cgggcgccaggtagctccggtcgggcacgcgcagtccgacagactgtgtcaccttggaagacaggatgcggccctttacctag

SEQ ID NO: 3432 - DNA, 524 bp, Homo sapiens
  chr9:96716904-96717428
  hyper
cgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcat

SEQ ID NO: 3433 - DNA, 85 bp, Homo sapiens
  chr9:96717449-96717534
  hyper
cgcggtttggcggcggcggcggcgacggcttggctccggcgcggggcccgcgcggggctctaggccggcccgcagctcggggcgg

SEQ ID NO: 3434 - DNA, 220 bp, Homo sapiens
  chr9:96717979-96718199
  hyper
tgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctggg

SEQ ID NO: 3435 - DNA, 8 bp, Homo sapiens
  chr9:96720878-96720886
  hyper
gaaaatcc

SEQ ID NO: 3436 - DNA, 366 bp, Homo sapiens; identical to SEQ ID NO: 857
  chr9:96721102-96721468
  hyper

SEQ ID NO: 3437 - DNA, 114 bp, Homo sapiens; identical to SEQ ID NO: 858
  chr9:96721688-96721802
  hyper

SEQ ID NO: 3438 - DNA, 212 bp, Homo sapiens; identical to SEQ ID NO: 859
  chr9:98111349-98111561
  hyper

SEQ ID NO: 3439 - DNA, 264 bp, Homo sapiens; identical to SEQ ID NO: 860
  chr9:98111894-98112158
  hyper

SEQ ID NO: 3440 - DNA, 52 bp, Homo sapiens; identical to SEQ ID NO: 861
  chr9:98112343-98112395
  hyper

SEQ ID NO: 3441 - DNA, 306 bp, Homo sapiens
  chr9:98789707-98790013
  hyper
aggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 3442 - DNA, 432 bp, Homo sapiens; identical to SEQ ID NO: 862
  chr9:99639601-99640033
  hyper

SEQ ID NO: 3443 - DNA, 27 bp, Homo sapiens
  chr9:99983988-99984015
  hyper
tcgcgcaggacatcccggaatcgcagg

SEQ ID NO: 3444 - DNA, 40 bp, Homo sapiens
  chr9:100610095-100610135
  hyper
ccctcacttccagcccgcaggctgccgcgggggtgactcc

SEQ ID NO: 3445 - DNA, 121 bp, Homo sapiens
  chr9:100610200-100610321
  hyper
cggcgaaacctagagagacttgcactccaggcccggggggtgggggggcgggggagaagccttagggagagtggggaggaggccagaggagagctggctgctctctcgtgttgaggttcaa

SEQ ID NO: 3446 - DNA, 92 bp, Homo sapiens; identical to SEQ ID NO: 863
  chr9:100610725-100610817
  hyper

SEQ ID NO: 3447 - DNA, 516 bp, Homo sapiens; identical to SEQ ID NO: 864
  chr9:100611124-100611640
  hyper

SEQ ID NO: 3448 - DNA, 10 bp, Homo sapiens
  chr9:100613990-100614000
  hyper
ttccacacac

SEQ ID NO: 3449 - DNA, 133 bp, Homo sapiens
  chr9:100614192-100614325
  hyper
cgcggctctgcacccacagccccggcccgccccccccccccaccccggaaagctgcgtccgggctggagccactggaacccgcgccaaggcccggaatcctatacgtagcaggggcctcggagatcagcacac

SEQ ID NO: 3450 - DNA, 133 bp, Homo sapiens
  chr9:100615068-100615201
  hyper
ccatcctgaaaggcccggggagccagtctcctggaacttctccctccccattcccacaaaaaccaagcgccctctcggccaattctcaccctctcaggacaaaaaagtgagatgagcccgtcctttcacctgc

SEQ ID NO: 3451 - DNA, 834 bp, Homo sapiens
  chr9:100615202-100616036
  hyper
agtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccag

SEQ ID NO: 3452 - DNA, 199 bp, Homo sapiens
  chr9:100616270-100616469
  hyper
ggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgc

SEQ ID NO: 3453 - DNA, 426 bp, Homo sapiens
  chr9:100620357-100620783
  hyper
tccgggccctgcacccgccagcgtcgtgtgcaggcgtccccgggctgtggataattagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaac

SEQ ID NO: 3454 - DNA, 87 bp, Homo sapiens
  chr9:101706109-101706196
  hyper
cagcgcgcgggggagcgcagggcgcggcggagtcgggtttcagagcgcgggtgactcggggcgcgggccgggagccgggattctgcc

SEQ ID NO: 3455 - DNA, 467 bp, Homo sapiens
  chr9:101706312-101706779
  hyper
cgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagct

SEQ ID NO: 3456 - DNA, 432 bp, Homo sapiens
  chr9:110228200-110228632
  hyper
gggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgc

SEQ ID NO: 3457 - DNA, 95 bp, Homo sapiens
  chr9:120177898-120177993
  hyper
cattctcccactgcccgcaaaccttcctctcccctccatccaggccttgtgctagcactaattgctaatggacagaggggcgtcgaactccaccg

SEQ ID NO: 3458 - DNA, 66 bp, Homo sapiens
  chr9:126774554-126774620
  hyper
gccaggcagctgaggcggggggcaagccctccctcggaggagccgcgcccccggccccgccggtcc

SEQ ID NO: 3459 - DNA, 92 bp, Homo sapiens
  chr9:126777655-126777747
  hyper
cgcggcggccaagagcgcggggctgggcgcagcaggggccaaccctctgggtcttccctactacaatggcgtgggcactgtgcagaaggggc

SEQ ID NO: 3460 - DNA, 423 bp, Homo sapiens
  chr9:126779621-126780044
  hyper
tgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 3461 - DNA, 31 bp, Homo sapiens
  chr9:126780284-126780315
  hyper
ggaccggccggacgcccggcctcccccagcc

SEQ ID NO: 3462 - DNA, 108 bp, Homo sapiens; identical to SEQ ID NO: 865
  chr9:127212898-127213006
  hyper

SEQ ID NO: 3463 - DNA, 150 bp, Homo sapiens
  chr9:127265875-127266025
  hyper
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaa

SEQ ID NO: 3464 - DNA, 438 bp, Homo sapiens
  chr9:129387866-129388304
  hyper
agggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggc

SEQ ID NO: 3465 - DNA, 201 bp, Homo sapiens
  chr9:129389016-129389217
  hyper
gcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtc

SEQ ID NO: 3466 - DNA, 187 bp, Homo sapiens
  chr9:129400940-129401127
  hyper
aaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtca

SEQ ID NO: 3467 - DNA, 93 bp, Homo sapiens
  chr9:129445473-129445566
  hyper
ggctgggagaggccccgcgaggcccgcagagcgcgcccgtctcgccgcgcattccagccgcgtgattgacgcgcgtaccggggcccccgcccg

SEQ ID NO: 3468 - DNA, 69 bp, Homo sapiens
  chr9:132382286-132382355
  hyper
gggaccaccccccaccggaaatgactcgggcccgccccccgggccccgcggggcctcactcagtggctc

SEQ ID NO: 3469 - DNA, 173 bp, Homo sapiens
  chr9:132382634-132382807
  hyper
gacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagcccct

SEQ ID NO: 3470 - DNA, 106 bp, Homo sapiens
  chr9:133308867-133308973
  hyper
ggcgtccccgccaaccgcaccgagctcagcatgctggagcccgacccccgcagccccttcgcgctgcgtccgctgcgcgcgggccttggcgcggtctacacccgtc

SEQ ID NO: 3471 - DNA, 125 bp, Homo sapiens
  chr9:133535809-133535934
  hyper
gggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 3472 - DNA, 149 bp, Homo sapiens
  chr9:133535971-133536120
  hyper
cggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagc

SEQ ID NO: 3473 - DNA, 196 bp, Homo sapiens
  chr9:133536149-133536345
  hyper
cgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctc

SEQ ID NO: 3474 - DNA, 160 bp, Homo sapiens
  chr9:133536346-133536506
  hyper
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggc

SEQ ID NO: 3475 - DNA, 238 bp, Homo sapiens
  chr9:133538169-133538407
  hyper
catgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctg

SEQ ID NO: 3476 - DNA, 525 bp, Homo sapiens
  chr9:133538655-133539180
  hyper
agctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggg

SEQ ID NO: 3477 - DNA, 742 bp, Homo sapiens; identical to SEQ ID NO: 866
  chr9:133541665-133542407
  hyper

SEQ ID NO: 3478 - DNA, 617 bp, Homo sapiens
  chr9:135455407-135456024
  hyper
ggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctg

SEQ ID NO: 3479 - DNA, 122 bp, Homo sapiens
  chr9:135458477-135458599
  hyper
cagggacatccttgccgactgcaaaccactcgcggcctgtgcaccctactctagcagcgggcagccggcagcccctgagcctgggggccgccttgcggccaaggccgcggaggactttagag

SEQ ID NO: 3480 - DNA, 91 bp, Homo sapiens
  chr9:135460069-135460160
  hyper
tcagccaggctgtgccgaccatgcctggaaagtaggcaggtttaacggagcggccaggaggagatccagaggcatgcgggtgtccccaggc

SEQ ID NO: 3481 - DNA, 271 bp, Homo sapiens
  chr9:135461541-135461812
  hyper
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttc

SEQ ID NO: 3482 - DNA, 275 bp, Homo sapiens; identical to SEQ ID NO: 867
  chr9:135462647-135462922
  hyper

SEQ ID NO: 3483 - DNA, 141 bp, Homo sapiens
  chr9:135464798-135464939
  hyper
agacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 3484 - DNA, 144 bp, Homo sapiens
  chr9:137533823-137533967
  hyper
tcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 3485 - DNA, 87 bp, Homo sapiens
  chr9:137534065-137534152
  hyper
cgcgctccgcccgggcgccccgctgctgcccccgctgctgctgctgctgctgtgggcgccgcctccgagccgcgcaggtaagggcgc

SEQ ID NO: 3486 - DNA, 95 bp, Homo sapiens
  chr9:138606154-138606249
  hyper
cctcctgccaggccccggggccgctttggagggagccccgccccctgcccctgcgcagcccccgccctagccccagcccggcgcagccggtcccg

SEQ ID NO: 3487 - DNA, 142 bp, Homo sapiens
  chr9:139024749-139024891
  hyper
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcg

SEQ ID NO: 3488 - DNA, 23 bp, Homo sapiens
  chr9:140033468-140033491
  hyper
gcgctccgacacacacgctcacg

SEQ ID NO: 3489 - DNA, 9 bp, Homo sapiens
  chr9:140033618-140033627
  hyper
cgtccggac

SEQ ID NO: 3490 - DNA, 382 bp, Homo sapiens
  chr9:140033762-140034144
  hyper
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcc

SEQ ID NO: 3491 - DNA, 91 bp, Homo sapiens
  chr9:140772120-140772211
  hyper
ggggcggccgcggggcggggccggcgcggcagggtgggcggggccggcgcggattggccgggccccgccacgtgaccggccccttataggg

SEQ ID NO: 3492 - DNA, 545 bp, Homo sapiens; identical to SEQ ID NO: 868
  chr9:140772756-140773301
  hyper

SEQ ID NO: 3493 - DNA, 239 bp, Homo sapiens
  chr10:1778844-1779083
  hyper
gagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 3494 - DNA, 29 bp, Homo sapiens
  chr10:1779111-1779140
  hyper
cggagcagccatcccgccagcaccccaaa

SEQ ID NO: 3495 - DNA, 121 bp, Homo sapiens; identical to SEQ ID NO: 869
  chr10:7450069-7450190
  hyper

SEQ ID NO: 3496 - DNA, 1772 bp, Homo sapiens; identical to SEQ ID NO: 870
  chr10:7450490-7452262
  hyper

SEQ ID NO: 3497 - DNA, 446 bp, Homo sapiens
  chr10:7452546-7452992
  hyper
aatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattcca

SEQ ID NO: 3498 - DNA, 605 bp, Homo sapiens
  chr10:7453052-7453657
  hyper
tttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 3499 - DNA, 93 bp, Homo sapiens
  chr10:7453902-7453995
  hyper
cgcagagcccaaacgaaatgtccccagtgcggaaaagccggtgacgccctggtagcaagaccaagagcttccgaagaacgctgcgcccttaac

SEQ ID NO: 3500 - DNA, 15 bp, Homo sapiens
  chr10:8075930-8075945
  hyper
gctggcagccaactt

SEQ ID NO: 3501 - DNA, 124 bp, Homo sapiens
  chr10:8076053-8076177
  hyper
cgacggacagtcccgggcttagggagggaggctgatcccgggagctctcaggagtccttccacctgccacctaggagcccagttcgcatctctacagcgccacacatctaggccagcccagctc

SEQ ID NO: 3502 - DNA, 39 bp, Homo sapiens
  chr10:8076448-8076487
  hyper
cataaaaaacaaagacgggggcggcggagggtgtggaag

SEQ ID NO: 3503 - DNA, 96 bp, Homo sapiens
  chr10:8077922-8078018
  hyper
cccggcacccaactgcggggcacgcgcccgttgctcggccctaaaggggcctagagctgcgccccgggggcgcggaaggtgcggggagagggggtg

SEQ ID NO: 3504 - DNA, 376 bp, Homo sapiens; identical to SEQ ID NO: 871
  chr10:8085599-8085975
  hyper

SEQ ID NO: 3505 - DNA, 89 bp, Homo sapiens
  chr10:8097108-8097197
  hyper
gagccctgcgggctccgcggccgtgtccccgcgctcccgtgcgggtctcgggtgcgctgggcgggcgggcggcgcgaggggaggttgtg

SEQ ID NO: 3506 - DNA, 172 bp, Homo sapiens
  chr10:11059492-11059664
  hyper
atcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 3507 - DNA, 120 bp, Homo sapiens
  chr10:11059932-11060052
  hyper
ggctcggcggccgccgggggaggccgcgcgcacctgtccctgcccgtctcgcgccgcccgcggccgctcggacgcgcgcagagccgccccccgccgctgccgccgcgtgcgcccgcgaac

SEQ ID NO: 3508 - DNA, 33 bp, Homo sapiens
  chr10:13933506-13933539
  hyper
ccagtaaagaagcagcggcgcgtcccttttccc

SEQ ID NO: 3509 - DNA, 339 bp, Homo sapiens
  chr10:13933596-13933935
  hyper
cgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccgg

SEQ ID NO: 3510 - DNA, 14 bp, Homo sapiens
  chr10:13933982-13933996
  hyper
cgccaccgcccgcc

SEQ ID NO: 3511 - DNA, 129 bp, Homo sapiens
  chr10:13933997-13934126
  hyper
cccgatcctggacaacaatgcgcgcccccgcccccccagaaagccagggacgcccccagtcgccgccagagctggctcggcttcccagcccctctccgtggcacccgcaggcgagacaaagttcgctcc

SEQ ID NO: 3512 - DNA, 75 bp, Homo sapiens
  chr10:13934168-13934243
  hyper
cggaggtccccaagcgggggacccctggctcccccacaaaacccacccaaagccaccgctcgaggccctctccta

SEQ ID NO: 3513 - DNA, 858 bp, Homo sapiens; identical to SEQ ID NO: 872
  chr10:15760996-15761854
  hyper

SEQ ID NO: 3514 - DNA, 111 bp, Homo sapiens; identical to SEQ ID NO: 873
  chr10:15761855-15761966
  hyper

SEQ ID NO: 3515 - DNA, 81 bp, Homo sapiens
  chr10:16562545-16562626
  hyper
gaagaagtagatgcccgggatggagcaggtgaacttgccggtggtggggtcgtagtggtttccgaggttggtgaccacgtc

SEQ ID NO: 3516 - DNA, 46 bp, Homo sapiens
  chr10:16562627-16562673
  hyper
tcgaacttgagcacctcgtagccttcatgctgccgcttgaggccgg

SEQ ID NO: 3517 - DNA, 956 bp, Homo sapiens
  chr10:16562709-16563665
  hyper
cggcgctgatggccccggccgcgttcaggccgggcgccccgggcgggcccggcaggccttggcggcccggctcgcccttctcgcccgggggccccatggggccgggtggcccgggctctccggggggcccgcgcggacccgccttcccgggcctgccggcctcgcctttggggccctggatgaaggtgggcagggactgcatgaggccgcggtcgggcgtggcagcggtgctgggcgccttggtgcccccgtaggggtcgcagaccatgcggcaggtgcccagcatctcgtagtgcgccgacgtgccggccgagctcaccagcaccgggatgaggatcaccagcagcagcaccatcaccacccccagcgccccggcggcgatcaggcgcctcctgctgcccaccagccggctcagcgcggggcgatcctcttgtctgcttttggacagaattttgaaggttgggcggggacctcttcagagccgaaaacaaccccctgcgaaccccaactcccctgggcgtgcgtgcgccggccgctgctgccgactcctgctccccccgcggaggctgcggctggggagggagcgcgggcgcccagtgacttgagccgaagtcccgagcccggggtgggggccgggggaggggtgcgcggggcgccctcgccccccgcgagctccttcgcacctgtggctgcagccggcgccggcgcggccaccgggagggcagagccagccgccgcctcctgagctcgcccgggcagctcacacttttatgccgccgccgcctgcgatcgacttttccgtttttgcagactgcgcctgttcgcaccaactttccgtctgaagttgcctttttctgcctcctcctcctcttctttcgctcgctcagttcgcccgtccgctgccttttttttttattgcctcctttctctcttcctcctttgccaccaccacaact

SEQ ID NO: 3518 - DNA, 261 bp, Homo sapiens
  chr10:16563690-16563951
  hyper
cgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctca

SEQ ID NO: 3519 - DNA, 32 bp, Homo sapiens
  chr10:17271223-17271255
  hyper
gaccctctttcctaacggggttataaaaacag

SEQ ID NO: 3520 - DNA, 76 bp, Homo sapiens
  chr10:17271443-17271519
  hyper
cgtcctcctaccgcaggatgttcggcggcccgggcaccgcgagccggccgagctccagccggagctacgtgactac

SEQ ID NO: 3521 - DNA, 221 bp, Homo sapiens
  chr10:17271520-17271741
  hyper
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagct

SEQ ID NO: 3522 - DNA, 615 bp, Homo sapiens; identical to SEQ ID NO: 874
  chr10:22541236-22541851
  hyper

SEQ ID NO: 3523 - DNA, 226 bp, Homo sapiens; identical to SEQ ID NO: 875
  chr10:22542024-22542250
  hyper

SEQ ID NO: 3524 - DNA, 560 bp, Homo sapiens; identical to SEQ ID NO: 876
  chr10:22624561-22625121
  hyper

SEQ ID NO: 3525 - DNA, 401 bp, Homo sapiens; identical to SEQ ID NO: 877
  chr10:22625382-22625783
  hyper

SEQ ID NO: 3526 - DNA, 292 bp, Homo sapiens; identical to SEQ ID NO: 878
  chr10:22625811-22626103
  hyper

SEQ ID NO: 3527 - DNA, 190 bp, Homo sapiens; identical to SEQ ID NO: 879
  chr10:22633985-22634175
  hyper

SEQ ID NO: 3528 - DNA, 108 bp, Homo sapiens; identical to SEQ ID NO: 880
  chr10:22634324-22634432
  hyper

SEQ ID NO: 3529 - DNA, 6 bp, Homo sapiens
  chr10:22634433-22634439
  hyper
gctccc

SEQ ID NO: 3530 - DNA, 215 bp, Homo sapiens; identical to SEQ ID NO: 882
  chr10:22634440-22634655
  hyper

SEQ ID NO: 3531 - DNA, 897 bp, Homo sapiens; identical to SEQ ID NO: 883
  chr10:22764693-22765590
  hyper

SEQ ID NO: 3532 - DNA, 274 bp, Homo sapiens
  chr10:23216856-23217130
  hyper
tcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 3533 - DNA, 91 bp, Homo sapiens
  chr10:23462524-23462615
  hyper
ccggtgcccacatgccgcccccacacgcccccacccccgtccggcgcaagacttcccttggccaaaagaggcgtttaattagttctggggc

SEQ ID NO: 3534 - DNA, 298 bp, Homo sapiens
  chr10:23462634-23462932
  hyper
cgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtg

SEQ ID NO: 3535 - DNA, 588 bp, Homo sapiens
  chr10:23463266-23463854
  hyper
cgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctc

SEQ ID NO: 3536 - DNA, 190 bp, Homo sapiens
  chr10:23463887-23464077
  hyper
cgctcttgctcctctgcagccatagcagccagccaggggtgcagacggagatcctagctgccgggacagaaaaagctgcaggggcctggctgcccagtcccgatttggtttcaagactaacggcagcaggaggtcacaggaggcttgaacctctccggggagacaaccgctgtgccggggaagaaacatt

SEQ ID NO: 3537 - DNA, 734 bp, Homo sapiens; identical to SEQ ID NO: 884
  chr10:23483777-23484511
  hyper

SEQ ID NO: 3538 - DNA, 413 bp, Homo sapiens
  chr10:23487742-23488155
  hyper
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtg

SEQ ID NO: 3539 - DNA, 1097 bp, Homo sapiens; identical to SEQ ID NO: 885
  chr10:23488393-23489490
  hyper

SEQ ID NO: 3540 - DNA, 886 bp, Homo sapiens; identical to SEQ ID NO: 886
  chr10:23982394-23983280
  hyper

SEQ ID NO: 3541 - DNA, 83 bp, Homo sapiens
  chr10:23984130-23984213
  hyper
ggagaggcgagggggcggcagcctcggcccgaagtaagtgcagcagaagtttgcgtcggttgccccgccgctcccccagcgcg

SEQ ID NO: 3542 - DNA, 147 bp, Homo sapiens
  chr10:25465203-25465350
  hyper
ttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgac

SEQ ID NO: 3543 - DNA, 204 bp, Homo sapiens
  chr10:25465351-25465555
  hyper
cgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgctt

SEQ ID NO: 3544 - DNA, 279 bp, Homo sapiens; identical to SEQ ID NO: 887
  chr10:26500592-26500871
  hyper

SEQ ID NO: 3545 - DNA, 130 bp, Homo sapiens
  chr10:26504014-26504144
  hyper
cccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 3546 - DNA, 694 bp, Homo sapiens
  chr10:26504190-26504884
  hyper
cgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaacgagggccctgcaggcgatgccttctttcctactcggatttgtaaagccgagattgcttagttggaaaccctgttctcccctcccaggcgcacacagatcccccttacacgcaagcagcgggcgcttccacgcctccgcgggccaaggtcaccaaatgccctgattccatcccccacccgccatcaatcctgccgactctggccgctctgcctcattctcttccaagaagtttccattcgttttatttttttttccccagcccgaggtcctcagtagactccagcgtggattttaattgcctcaatcagcagtcattctccccagccgtcactcagagcctggacggtgggtcccgcgatctagcccttggctacgcaggaacggtgcgcccc

SEQ ID NO: 3547 - DNA, 200 bp, Homo sapiens
  chr10:26505008-26505208
  hyper
cgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgc

SEQ ID NO: 3548 - DNA, 90 bp, Homo sapiens
  chr10:26506073-26506163
  hyper
ggggacatggaattccgtggtcctggggcgctgctaagatccgggtgtctggaccctggggtgggacggagtgaccgtgaagatagaaaa

SEQ ID NO: 3549 - DNA, 246 bp, Homo sapiens; identical to SEQ ID NO: 888
  chr10:26506373-26506619
  hyper

SEQ ID NO: 3550 - DNA, 518 bp, Homo sapiens; identical to SEQ ID NO: 889
  chr10:26506902-26507420
  hyper

SEQ ID NO: 3551 - DNA, 200 bp, Homo sapiens; identical to SEQ ID NO: 890
  chr10:26727617-26727817
  hyper

SEQ ID NO: 3552 - DNA, 183 bp, Homo sapiens; identical to SEQ ID NO: 891
  chr10:26727867-26728050
  hyper

SEQ ID NO: 3553 - DNA, 606 bp, Homo sapiens
  chr10:27547726-27548332
  hyper
gcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 3554 - DNA, 15 bp, Homo sapiens
  chr10:27548400-27548415
  hyper
cgaatccattcttgg

SEQ ID NO: 3555 - DNA, 391 bp, Homo sapiens
  chr10:28034909-28035300
  hyper
ccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtg

SEQ ID NO: 3556 - DNA, 374 bp, Homo sapiens
  chr10:43250406-43250780
  hyper
aggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacc

SEQ ID NO: 3557 - DNA, 39 bp, Homo sapiens
  chr10:43250854-43250893
  hyper
cgcccaggccgccggctcggtgagcgcagagaggggccc

SEQ ID NO: 3558 - DNA, 92 bp, Homo sapiens; identical to SEQ ID NO: 892
  chr10:43429066-43429158
  hyper

SEQ ID NO: 3559 - DNA, 77 bp, Homo sapiens
  chr10:43429361-43429438
  hyper
tagcccagctgcagccggatcctccctgagcgcagcgcaggggtcacagcccccgacagctgcgcaagtctattcct

SEQ ID NO: 3560 - DNA, 28 bp, Homo sapiens
  chr10:49732060-49732088
  hyper
ccgcagggagcggggcgcacgtgcgcgc

SEQ ID NO: 3561 - DNA, 160 bp, Homo sapiens
  chr10:49732155-49732315
  hyper
cgcccgcggccccgccgctcggctcctctccccgcctgccgcctgcgccccggggcggcgcggccgaggtccggcccacgggcagtgcccagctgggcgcagggtgcgcgggaccgccggcccgcggctcccgggccctcacactccaccgcggccccgc

SEQ ID NO: 3562 - DNA, 227 bp, Homo sapiens
  chr10:49732316-49732543
  hyper
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgc

SEQ ID NO: 3563 - DNA, 261 bp, Homo sapiens
  chr10:50603909-50604170
  hyper
ggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctc

SEQ ID NO: 3564 - DNA, 1458 bp, Homo sapiens; identical to SEQ ID NO: 893
  chr10:50605213-50606671
  hyper

SEQ ID NO: 3565 - DNA, 189 bp, Homo sapiens
  chr10:50821472-50821661
  hyper
agagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgt

SEQ ID NO: 3566 - DNA, 30 bp, Homo sapiens
  chr10:60937073-60937103
  hyper
aaggggaaatgccctcgggatgtttctagc

SEQ ID NO: 3567 - DNA, 342 bp, Homo sapiens
  chr10:64578287-64578629
  hyper
gctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgc

SEQ ID NO: 3568 - DNA, 5 bp, Homo sapiens
  chr10:64578651-64578656
  hyper
cgagg

SEQ ID NO: 3569 - DNA, 462 bp, Homo sapiens; identical to SEQ ID NO: 894
  chr10:71331980-71332442
  hyper

SEQ ID NO: 3570 - DNA, 89 bp, Homo sapiens
  chr10:72015293-72015382
  hyper
gggcgtacatgaccacgatgagcgccagcggcgccaggtagatgtgcgagaagagcacagtggtgtagaccctgcgcatgcccttctcg

SEQ ID NO: 3571 - DNA, 15 bp, Homo sapiens
  chr10:72200050-72200065
  hyper
gccccctcccatccc

SEQ ID NO: 3572 - DNA, 655 bp, Homo sapiens; identical to SEQ ID NO: 896
  chr10:72200117-72200772
  hyper

SEQ ID NO: 3573 - DNA, 557 bp, Homo sapiens; identical to SEQ ID NO: 897
  chr10:72200824-72201381
  hyper

SEQ ID NO: 3574 - DNA, 72 bp, Homo sapiens
  chr10:73847720-73847792
  hyper
gggacaggggaggggcgctgggctgtgacccccagtactgtttactttccgtgtaattagccggccaggctg

SEQ ID NO: 3575 - DNA, 14 bp, Homo sapiens
  chr10:73848208-73848222
  hyper
ggtgactggcggag

SEQ ID NO: 3576 - DNA, 777 bp, Homo sapiens
  chr10:79396686-79397463
  hyper
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccacccc

SEQ ID NO: 3577 - DNA, 512 bp, Homo sapiens
  chr10:90967644-90968156
  hyper
gtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccg

SEQ ID NO: 3578 - DNA, 139 bp, Homo sapiens
  chr10:92617227-92617366
  hyper
ggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggc

SEQ ID NO: 3579 - DNA, 159 bp, Homo sapiens; identical to SEQ ID NO: 898
  chr10:94828735-94828894
  hyper

SEQ ID NO: 3580 - DNA, 937 bp, Homo sapiens; identical to SEQ ID NO: 899
  chr10:94834033-94834970
  hyper

SEQ ID NO: 3581 - DNA, 185 bp, Homo sapiens
  chr10:99080262-99080447
  hyper
gcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgcca

SEQ ID NO: 3582 - DNA, 119 bp, Homo sapiens; identical to SEQ ID NO: 900
  chr10:99789175-99789294
  hyper

SEQ ID NO: 3583 - DNA, 32 bp, Homo sapiens; identical to SEQ ID NO: 901
  chr10:99790308-99790340
  hyper

SEQ ID NO: 3584 - DNA, 323 bp, Homo sapiens; identical to SEQ ID NO: 902
  chr10:99790437-99790760
  hyper

SEQ ID NO: 3585 - DNA, 260 bp, Homo sapiens; identical to SEQ ID NO: 903
  chr10:99790917-99791177
  hyper

SEQ ID NO: 3586 - DNA, 74 bp, Homo sapiens; identical to SEQ ID NO: 904
  chr10:100992117-100992191
  hyper

SEQ ID NO: 3587 - DNA, 5 bp, Homo sapiens
  chr10:100992221-100992226
  hyper
cgggc

SEQ ID NO: 3588 - DNA, 451 bp, Homo sapiens; identical to SEQ ID NO: 906
  chr10:100993487-100993938
  hyper

SEQ ID NO: 3589 - DNA, 456 bp, Homo sapiens; identical to SEQ ID NO: 907
  chr10:100993939-100994395
  hyper

SEQ ID NO: 3590 - DNA, 427 bp, Homo sapiens; identical to SEQ ID NO: 908
  chr10:100995797-100996224
  hyper

SEQ ID NO: 3591 - DNA, 327 bp, Homo sapiens; identical to SEQ ID NO: 909
  chr10:101290372-101290699
  hyper

SEQ ID NO: 3592 - DNA, 443 bp, Homo sapiens; identical to SEQ ID NO: 910
  chr10:101290700-101291143
  hyper

SEQ ID NO: 3593 - DNA, 403 bp, Homo sapiens; identical to SEQ ID NO: 911
  chr10:101292461-101292864
  hyper

SEQ ID NO: 3594 - DNA, 290 bp, Homo sapiens
  chr10:101293164-101293454
  hyper
gtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgac

SEQ ID NO: 3595 - DNA, 644 bp, Homo sapiens
  chr10:101294756-101295400
  hyper
agaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 3596 - DNA, 152 bp, Homo sapiens
  chr10:101295401-101295553
  hyper
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgac

SEQ ID NO: 3597 - DNA, 111 bp, Homo sapiens
  chr10:102484269-102484380
  hyper
cgcggggccccggggcggctccaagcccggcgggctccgcggcggcggcgaccaggctcgcttcccacttgggctgcgggcggcatggtccctctgcgcccatccggctct

SEQ ID NO: 3598 - DNA, 15 bp, Homo sapiens
  chr10:102497161-102497176
  hyper
gggcggccgcttacc

SEQ ID NO: 3599 - DNA, 46 bp, Homo sapiens
  chr10:102497252-102497298
  hyper
cgggtgcgggtctcgtgttccaggcagcagcagctccgggaaaggc

SEQ ID NO: 3600 - DNA, 26 bp, Homo sapiens
  chr10:102497299-102497325
  hyper
ggggggagctgcggagctgggcagga

SEQ ID NO: 3601 - DNA, 241 bp, Homo sapiens; identical to SEQ ID NO: 912
  chr10:102497525-102497766
  hyper

SEQ ID NO: 3602 - DNA, 128 bp, Homo sapiens
  chr10:102501247-102501375
  hyper
aggagggggaaaggccgggcaggagccggtcaggcctttctgcggaaggggctggggtgtaagtttcggctccctgggatctgacagccgagggtatgcgccctggggtgcgccgggacccagagggc

SEQ ID NO: 3603 - DNA, 69 bp, Homo sapiens; identical to SEQ ID NO: 913
  chr10:102507467-102507536
  hyper

SEQ ID NO: 3604 - DNA, 1165 bp, Homo sapiens; identical to SEQ ID NO: 914
  chr10:102589250-102590415
  hyper

SEQ ID NO: 3605 - DNA, 51 bp, Homo sapiens
  chr10:102890968-102891019
  hyper
caccccgctcctctccgcgcacagccaatggagagacccagtcgaaaccgc

SEQ ID NO: 3606 - DNA, 274 bp, Homo sapiens
  chr10:102891020-102891294
  hyper
aagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggc

SEQ ID NO: 3607 - DNA, 380 bp, Homo sapiens
  chr10:102891576-102891956
  hyper
catgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctg

SEQ ID NO: 3608 - DNA, 369 bp, Homo sapiens; identical to SEQ ID NO: 915
  chr10:102893583-102893952
  hyper

SEQ ID NO: 3609 - DNA, 1155 bp, Homo sapiens; identical to SEQ ID NO: 916
  chr10:102894090-102895245
  hyper

SEQ ID NO: 3610 - DNA, 683 bp, Homo sapiens; identical to SEQ ID NO: 917
  chr10:102899173-102899856
  hyper

SEQ ID NO: 3611 - DNA, 372 bp, Homo sapiens; identical to SEQ ID NO: 918
  chr10:102900262-102900634
  hyper

SEQ ID NO: 3612 - DNA, 135 bp, Homo sapiens; identical to SEQ ID NO: 919
  chr10:102983245-102983380
  hyper

SEQ ID NO: 3613 - DNA, 315 bp, Homo sapiens; identical to SEQ ID NO: 920
  chr10:102983434-102983749
  hyper

SEQ ID NO: 3614 - DNA, 1497 bp, Homo sapiens
  chr10:102985456-102986953
  hyper
caaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 3615 - DNA, 136 bp, Homo sapiens
  chr10:102987206-102987342
  hyper
gccaccgccggctgtggcctccgagttctgctcgagttcggccagcgccacgatgtccatctgcccgctggggcccagtttcttggcggactctacgtcggccttcatctcctccaggtcccgcttgagcttagcg

SEQ ID NO: 3616 - DNA, 455 bp, Homo sapiens; identical to SEQ ID NO: 921
  chr10:102996026-102996481
  hyper

SEQ ID NO: 3617 - DNA, 123 bp, Homo sapiens; identical to SEQ ID NO: 922
  chr10:102996596-102996719
  hyper

SEQ ID NO: 3618 - DNA, 142 bp, Homo sapiens
  chr10:102997086-102997228
  hyper
cagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 3619 - DNA, 303 bp, Homo sapiens
  chr10:102997281-102997584
  hyper
cgccacagccctgtcccctagggagaggcctggactaactttgccgtcctcgtggccttagcccggactgtgagtctcgagcggcttccgagaggcagctcgggtgtcttcgcagagacagatgaggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 3620 - DNA, 503 bp, Homo sapiens; identical to SEQ ID NO: 923
  chr10:102998356-102998859
  hyper

SEQ ID NO: 3621 - DNA, 304 bp, Homo sapiens; identical to SEQ ID NO: 924
  chr10:103043924-103044228
  hyper

SEQ ID NO: 3622 - DNA, 99 bp, Homo sapiens; identical to SEQ ID NO: 925
  chr10:103044300-103044399
  hyper

SEQ ID NO: 3623 - DNA, 177 bp, Homo sapiens
  chr10:103536320-103536497
  hyper
gggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccg

SEQ ID NO: 3624 - DNA, 62 bp, Homo sapiens
  chr10:104170201-104170263
  hyper
ctttttggctgtccacgcggcgggggagcagtgtggagtgtacccccatccaatccctgtcc

SEQ ID NO: 3625 - DNA, 106 bp, Homo sapiens
  chr10:104170407-104170513
  hyper
cgcatgtgcgcatgttccgggagagcctgcgcgtggggcctggggagggggcggtccccaggctgagtcacgagagcccgggcttccgtggcaggagccgggggtc

SEQ ID NO: 3626 - DNA, 287 bp, Homo sapiens
  chr10:104170514-104170801
  hyper
gcaagccccagccctgccctccctccgactctggactccgtcgccgactgggtcctccatccttcccctccagcgacttctaccctgccccgccccccaccttgagcagctccctagggaagtcgccgccatcattgaggccctccaggttcccgatgaagtccccgcaggtcatgcgcttcccgatgttctaaggaagggaacggaggcctgtgagtttggagggcccttggcctcccaggtcctgcatgtctggccaggggtttgttttccggctcctgcccgcc

SEQ ID NO: 3627 - DNA, 209 bp, Homo sapiens
  chr10:105036450-105036659
  hyper
gtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttc

SEQ ID NO: 3628 - DNA, 163 bp, Homo sapiens
  chr10:105036700-105036863
  hyper
cgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggc

SEQ ID NO: 3629 - DNA, 19 bp, Homo sapiens
  chr10:105036864-105036883
  hyper
ccttaaaagccgggcgcac

SEQ ID NO: 3630 - DNA, 717 bp, Homo sapiens
  chr10:105036893-105037610
  hyper
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggag

SEQ ID NO: 3631 - DNA, 934 bp, Homo sapiens
  chr10:106399442-106400376
  hyper
atcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccggg

SEQ ID NO: 3632 - DNA, 110 bp, Homo sapiens
  chr10:106400808-106400918
  hyper
taagaaagaaagcaccgaaggggcaattattaattttcctcgggtttggaatcaccctctggacaagagaacgggcgagcgggagctaggagggaagagtggagaggacc

SEQ ID NO: 3633 - DNA, 111 bp, Homo sapiens
  chr10:106401322-106401433
  hyper
gtgctggggcgccgggccggaccagagctgctgccccagcagggcggcggcagaggcggtgagatgcaggtggaagccggagggacatcaccggcaggcgagcggcggggc

SEQ ID NO: 3634 - DNA, 681 bp, Homo sapiens
  chr10:106401510-106402191
  hyper
cggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtgagtacccacccggcggcgggtccgcctgtttcctgacaccgaaggggaatgggggggtgggtgggagcgagggacagatagttgctcgggggtcgaggcgggggacgcctcgacttttcgagataacaggtttgtccgattccccccacgcccccaacaggttaacggagtttgttgttagacgctgtgtgtgtttgtttactggagaccctaggcttcggccgccgggaggggagtggaggaaggggcttcttaaagatgagtgggggagggatctgtgctcactttctccaatacttggcttggagggtcagttttcctgtttgcggggtgcttgaattcttggatgagaaaaagggctgacttggggcgggagccgctgaacagaccgattcctgcggctgccgggctccccctacccccaccccacccccaccccccctcccgtcacgcgaaagggaacccggaaggccatt

SEQ ID NO: 3635 - DNA, 80 bp, Homo sapiens
  chr10:106402271-106402351
  hyper
cggccaagtcggcccccagccttggccttcaggtaaccccggttcctccttcaaagtccagggagcggccctggaaagcc

SEQ ID NO: 3636 - DNA, 205 bp, Homo sapiens
  chr10:106402620-106402825
  hyper
cggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 3637 - DNA, 180 bp, Homo sapiens
  chr10:110672065-110672245
  hyper
cagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggacccc

SEQ ID NO: 3638 - DNA, 51 bp, Homo sapiens
  chr10:111216345-111216396
  hyper
agatgtgcagagagtcgcctgtcggagcaaatgtgacgctgattggcttca

SEQ ID NO: 3639 - DNA, 79 bp, Homo sapiens; identical to SEQ ID NO: 926
  chr10:115804976-115805055
  hyper

SEQ ID NO: 3640 - DNA, 397 bp, Homo sapiens
  chr10:118032412-118032809
  hyper
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaa

SEQ ID NO: 3641 - DNA, 95 bp, Homo sapiens; identical to SEQ ID NO: 927
  chr10:118033068-118033163
  hyper

SEQ ID NO: 3642 - DNA, 454 bp, Homo sapiens; identical to SEQ ID NO: 928
  chr10:118033223-118033677
  hyper

SEQ ID NO: 3643 - DNA, 157 bp, Homo sapiens
  chr10:118890938-118891095
  hyper
gatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtc

SEQ ID NO: 3644 - DNA, 145 bp, Homo sapiens; identical to SEQ ID NO: 929
  chr10:118891517-118891662
  hyper

SEQ ID NO: 3645 - DNA, 59 bp, Homo sapiens; identical to SEQ ID NO: 930
  chr10:118891715-118891774
  hyper

SEQ ID NO: 3646 - DNA, 444 bp, Homo sapiens; identical to SEQ ID NO: 931
  chr10:118892013-118892457
  hyper

SEQ ID NO: 3647 - DNA, 44 bp, Homo sapiens; identical to SEQ ID NO: 932
  chr10:118892517-118892561
  hyper

SEQ ID NO: 3648 - DNA, 283 bp, Homo sapiens; identical to SEQ ID NO: 933
  chr10:118892955-118893238
  hyper

SEQ ID NO: 3649 - DNA, 72 bp, Homo sapiens; identical to SEQ ID NO: 934
  chr10:118893679-118893751
  hyper

SEQ ID NO: 3650 - DNA, 14 bp, Homo sapiens
  chr10:118894477-118894491
  hyper
ggaatttccggtgg

SEQ ID NO: 3651 - DNA, 353 bp, Homo sapiens; identical to SEQ ID NO: 935
  chr10:118899892-118900245
  hyper

SEQ ID NO: 3652 - DNA, 113 bp, Homo sapiens; identical to SEQ ID NO: 936
  chr10:118900323-118900436
  hyper

SEQ ID NO: 3653 - DNA, 292 bp, Homo sapiens
  chr10:118924431-118924723
  hyper
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacaggg

SEQ ID NO: 3654 - DNA, 537 bp, Homo sapiens; identical to SEQ ID NO: 937
  chr10:118927026-118927563
  hyper

SEQ ID NO: 3655 - DNA, 244 bp, Homo sapiens
  chr10:119000911-119001155
  hyper
tggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggc

SEQ ID NO: 3656 - DNA, 200 bp, Homo sapiens
  chr10:119001328-119001528
  hyper
cgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgct

SEQ ID NO: 3657 - DNA, 183 bp, Homo sapiens
  chr10:119297461-119297644
  hyper
tggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccagg

SEQ ID NO: 3658 - DNA, 105 bp, Homo sapiens
  chr10:119301323-119301428
  hyper
ctagagaccgtggggcgagagagggagagagttggaagcccactgctccggcggggtcggcagctcccggtctcaactcgcaaacgaacgagccgggtcaagaat

SEQ ID NO: 3659 - DNA, 176 bp, Homo sapiens; identical to SEQ ID NO: 938
  chr10:122708495-122708671
  hyper

SEQ ID NO: 3660 - DNA, 38 bp, Homo sapiens; identical to SEQ ID NO: 939
  chr10:123922645-123922683
  hyper

SEQ ID NO: 3661 - DNA, 1013 bp, Homo sapiens
  chr10:124893594-124894607
  hyper
agcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 3662 - DNA, 52 bp, Homo sapiens
  chr10:124894870-124894922
  hyper
gggctcgcggccgttagtgcgcttcggccaagggcgccgcctgctccgcgtc

SEQ ID NO: 3663 - DNA, 535 bp, Homo sapiens; identical to SEQ ID NO: 940
  chr10:124895161-124895696
  hyper

SEQ ID NO: 3664 - DNA, 624 bp, Homo sapiens; identical to SEQ ID NO: 941
  chr10:124895832-124896456
  hyper

SEQ ID NO: 3665 - DNA, 437 bp, Homo sapiens
  chr10:124897220-124897657
  hyper
tccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattctt

SEQ ID NO: 3666 - DNA, 16 bp, Homo sapiens
  chr10:124897957-124897973
  hyper
ccggcctagtttattc

SEQ ID NO: 3667 - DNA, 114 bp, Homo sapiens
  chr10:124899035-124899149
  hyper
taagtacaacctggacgcacaaccctgtattccgggaggcggtggagacagaggcggctttgttcgcgaccagaggcactctctcccctgtactttccgcggcctgaaacgccc

SEQ ID NO: 3668 - DNA, 113 bp, Homo sapiens; identical to SEQ ID NO: 942
  chr10:124901934-124902047
  hyper

SEQ ID NO: 3669 - DNA, 431 bp, Homo sapiens; identical to SEQ ID NO: 943
  chr10:124902138-124902569
  hyper

SEQ ID NO: 3670 - DNA, 214 bp, Homo sapiens; identical to SEQ ID NO: 944
  chr10:124902607-124902821
  hyper

SEQ ID NO: 3671 - DNA, 267 bp, Homo sapiens; identical to SEQ ID NO: 945
  chr10:124903040-124903307
  hyper

SEQ ID NO: 3672 - DNA, 244 bp, Homo sapiens
  chr10:124904921-124905165
  hyper
gcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcga

SEQ ID NO: 3673 - DNA, 296 bp, Homo sapiens
  chr10:124907293-124907589
  hyper
cgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatg

SEQ ID NO: 3674 - DNA, 316 bp, Homo sapiens
  chr10:124907979-124908295
  hyper
gcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 3675 - DNA, 112 bp, Homo sapiens
  chr10:125651051-125651163
  hyper
tccagatctcctgcccgtaataatcagggtcctcgagggctgcgccctgggctccgaccccggccagggtcactgccaggagcaccagggccagcgctggggtagcggtccc

SEQ ID NO: 3676 - DNA, 88 bp, Homo sapiens
  chr10:125651372-125651460
  hyper
gcagaggcgcggggcgggcgcaggggggccggccccgcccttccttcttccctccctttcccggcgacccctccgaggccggtccttg

SEQ ID NO: 3677 - DNA, 109 bp, Homo sapiens
  chr10:126137296-126137405
  hyper
aagggggtttgaagtcggtacctgcaagctgcgggcaggagatatgcaggcgccagtaatagaatatcgatcacgagggtgggggaagggagggcggcccctcggagag

SEQ ID NO: 3678 - DNA, 219 bp, Homo sapiens
  chr10:128993945-128994164
  hyper
gtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgccc

SEQ ID NO: 3679 - DNA, 146 bp, Homo sapiens; identical to SEQ ID NO: 946
  chr10:130085053-130085199
  hyper

SEQ ID NO: 3680 - DNA, 76 bp, Homo sapiens; identical to SEQ ID NO: 947
  chr10:130085200-130085276
  hyper

SEQ ID NO: 3681 - DNA, 54 bp, Homo sapiens; identical to SEQ ID NO: 948
  chr10:130085355-130085409
  hyper

SEQ ID NO: 3682 - DNA, 698 bp, Homo sapiens
  chr10:131762639-131763337
  hyper
cctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 3683 - DNA, 780 bp, Homo sapiens
  chr10:131769496-131770276
  hyper
aagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcac

SEQ ID NO: 3684 - DNA, 121 bp, Homo sapiens
  chr10:133110064-133110185
  hyper
gcccccggacccggcccccgccccggtccccgcccgcccgcgcccctccccgccggaccccgccccgccctcgcgctccccggccctggccggggtctcctccccgctgcgcccctggacc

SEQ ID NO: 3685 - DNA, 290 bp, Homo sapiens
  chr10:133110553-133110843
  hyper
cgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggacc

SEQ ID NO: 3686 - DNA, 120 bp, Homo sapiens
  chr10:135044554-135044674
  hyper
cggacgcctcccccgcccccggctccccgccagctcccgccccgaccgccctcgccacctgcatccccgaggaccgcgcgcccgtccgcggccccgggtccccgccgccacccccggccc

SEQ ID NO: 3687 - DNA, 5 bp, Homo sapiens
  chr11:637259-637264
  hyper
cgacc

SEQ ID NO: 3688 - DNA, 118 bp, Homo sapiens
  chr11:637349-637467
  hyper
cgcgggccggccgcgggggcatctgcgggggcatctgcggggctggctgggcagggcgcggcggcgctggtggggggcgtgctgctcatcggcgcggtgctcgcggggaactcgctcg

SEQ ID NO: 3689 - DNA, 794 bp, Homo sapiens
  chr11:8189946-8190740
  hyper
gttgaaaaaacataacgacttaaggtttgctgtaccaattccatttgccttgatttcgtaccaagcggcgcgtcagaaagtacacggaaaacctaaagagggaaacccaactgggaacccttgactcaaagcacgtgaacaaatggtgacgagatgagttaagccagcggggtaagagagaagggactgcgcctaaacgggagtacgcaaggccacctagaggatgcacagacctgcatgcatacgttcctgacccttccagcagcagaaccatctgggccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaatggtac

SEQ ID NO: 3690 - DNA, 140 bp, Homo sapiens
  chr11:9112446-9112586
  hyper
gggtaattcccagatcggaacaggcgctgttccgctgacagaaaagtctctggagcccaccccgaagccatcagcagaacttgccggcccccaaagaaagaaacggcaaagctgccaccgcctcgcggatgtgcccggcc

SEQ ID NO: 3691 - DNA, 307 bp, Homo sapiens
  chr11:9112639-9112946
  hyper
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctc

SEQ ID NO: 3692 - DNA, 326 bp, Homo sapiens
  chr11:15136101-15136427
  hyper
ggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgg

SEQ ID NO: 3693 - DNA, 70 bp, Homo sapiens
  chr11:16632513-16632583
  hyper
cgcaagaaccccgggcgctgagctccggggaacctgggagggaaggaggggcgagcgggtggggctgact

SEQ ID NO: 3694 - DNA, 29 bp, Homo sapiens
  chr11:17497492-17497521
  hyper
ctttgcaagcaagggcgccggggtcgctg

SEQ ID NO: 3695 - DNA, 116 bp, Homo sapiens
  chr11:17497545-17497661
  hyper
cgcagagcctgagaagttgcgctctggagacacatgcccgggtggggtggcgggggaagggaatccaagtccctagctctcgcctctcctcgcccagggcgcgggcctgggactgt

SEQ ID NO: 3696 - DNA, 84 bp, Homo sapiens; identical to SEQ ID NO: 949
  chr11:17741806-17741890
  hyper

SEQ ID NO: 3697 - DNA, 135 bp, Homo sapiens; identical to SEQ ID NO: 950
  chr11:17741952-17742087
  hyper

SEQ ID NO: 3698 - DNA, 224 bp, Homo sapiens
  chr11:18813811-18814035
  hyper
tcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggc

SEQ ID NO: 3699 - DNA, 385 bp, Homo sapiens
  chr11:20178093-20178478
  hyper
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctg

SEQ ID NO: 3700 - DNA, 101 bp, Homo sapiens
  chr11:20181185-20181286
  hyper
tgtctcctagaagctcgaaggcagaaacgcagacgtccaggagcgtgcgctcagcgttactgcaccagatgactgcgcacagtctccgactgcgtgtgctc

SEQ ID NO: 3701 - DNA, 80 bp, Homo sapiens
  chr11:20183674-20183754
  hyper
gcccagctccagaggcgaattaatgctagaagatgacgtaagtgcggagtttctgagcccaagaccgctcatgctcatgg

SEQ ID NO: 3702 - DNA, 190 bp, Homo sapiens
  chr11:20184500-20184690
  hyper
cctgcttcctggggtcggtctccacagcctcctaaagaattcctaaagcgccaaagaggaaaagtgagggcgggggcgagggggcgagggctggccgcccgtgaaaggaaaaataaatcctaaggaagcaagaaatcggacgaaaggatcttactttaagtgatctccttgaacgcgtcttttcaaactc

SEQ ID NO: 3703 - DNA, 531 bp, Homo sapiens
  chr11:20184899-20185430
  hyper
gggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttgggg

SEQ ID NO: 3704 - DNA, 344 bp, Homo sapiens; identical to SEQ ID NO: 951
  chr11:20229223-20229567
  hyper

SEQ ID NO: 3705 - DNA, 30 bp, Homo sapiens; identical to SEQ ID NO: 952
  chr11:20618363-20618393
  hyper

SEQ ID NO: 3706 - DNA, 503 bp, Homo sapiens; identical to SEQ ID NO: 953
  chr11:20618422-20618925
  hyper

SEQ ID NO: 3707 - DNA, 50 bp, Homo sapiens
  chr11:20621603-20621653
  hyper
tgaaagggggttagacgagaggagtgcggtggaggcgaagataataggat

SEQ ID NO: 3708 - DNA, 101 bp, Homo sapiens; identical to SEQ ID NO: 954
  chr11:20623258-20623359
  hyper

SEQ ID NO: 3709 - DNA, 26 bp, Homo sapiens
  chr11:20691060-20691086
  hyper
gccagcggtggggggcgggctggggg

SEQ ID NO: 3710 - DNA, 40 bp, Homo sapiens; identical to SEQ ID NO: 956
  chr11:20691121-20691161
  hyper

SEQ ID NO: 3711 - DNA, 218 bp, Homo sapiens; identical to SEQ ID NO: 957
  chr11:20691162-20691380
  hyper

SEQ ID NO: 3712 - DNA, 185 bp, Homo sapiens; identical to SEQ ID NO: 958
  chr11:20691431-20691616
  hyper

SEQ ID NO: 3713 - DNA, 90 bp, Homo sapiens; identical to SEQ ID NO: 959
  chr11:20691747-20691837
  hyper

SEQ ID NO: 3714 - DNA, 105 bp, Homo sapiens
  chr11:22215182-22215287
  hyper
agtcctagggaggttcgctgcgtggcgtgctcagcgcgaaaccgggactgcggggcagagtcccccgcctggggtgagtggggttggtttcggcgccccacagat

SEQ ID NO: 3715 - DNA, 140 bp, Homo sapiens
  chr11:22365407-22365547
  hyper
gggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaa

SEQ ID NO: 3716 - DNA, 197 bp, Homo sapiens; identical to SEQ ID NO: 960
  chr11:27743436-27743633
  hyper

SEQ ID NO: 3717 - DNA, 15 bp, Homo sapiens
  chr11:30606740-30606755
  hyper
tgtagagaagaaatc

SEQ ID NO: 3718 - DNA, 292 bp, Homo sapiens
  chr11:30606795-30607087
  hyper
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatc

SEQ ID NO: 3719 - DNA, 1042 bp, Homo sapiens; identical to SEQ ID NO: 961
  chr11:31819319-31820361
  hyper

SEQ ID NO: 3720 - DNA, 565 bp, Homo sapiens; identical to SEQ ID NO: 962
  chr11:31820460-31821025
  hyper

SEQ ID NO: 3721 - DNA, 718 bp, Homo sapiens
  chr11:31824246-31824964
  hyper
atcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 3722 - DNA, 29 bp, Homo sapiens
  chr11:31826042-31826071
  hyper
acaggcgtttgggggatctgggctccggc

SEQ ID NO: 3723 - DNA, 198 bp, Homo sapiens; identical to SEQ ID NO: 964
  chr11:31826106-31826304
  hyper

SEQ ID NO: 3724 - DNA, 325 bp, Homo sapiens; identical to SEQ ID NO: 965
  chr11:31826408-31826733
  hyper

SEQ ID NO: 3725 - DNA, 117 bp, Homo sapiens; identical to SEQ ID NO: 966
  chr11:31827113-31827230
  hyper

SEQ ID NO: 3726 - DNA, 457 bp, Homo sapiens; identical to SEQ ID NO: 967
  chr11:31827597-31828054
  hyper

SEQ ID NO: 3727 - DNA, 220 bp, Homo sapiens
  chr11:31835591-31835811
  hyper
tgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtg

SEQ ID NO: 3728 - DNA, 438 bp, Homo sapiens; identical to SEQ ID NO: 968
  chr11:31836032-31836470
  hyper

SEQ ID NO: 3729 - DNA, 159 bp, Homo sapiens; identical to SEQ ID NO: 969
  chr11:31837354-31837513
  hyper

SEQ ID NO: 3730 - DNA, 735 bp, Homo sapiens; identical to SEQ ID NO: 970
  chr11:31837541-31838276
  hyper

SEQ ID NO: 3731 - DNA, 1227 bp, Homo sapiens
  chr11:31838719-31839946
  hyper
aattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 3732 - DNA, 132 bp, Homo sapiens
  chr11:31840041-31840173
  hyper
cgggggctccgggaagaggacatgcgacccctttttcagggcctaggccaaaggtctctccaggcctgctgggttctcaagagggaagccctaaagggggcctacccgggcttccctcgccctctggctgaa

SEQ ID NO: 3733 - DNA, 315 bp, Homo sapiens; identical to SEQ ID NO: 971
  chr11:31841774-31842089
  hyper

SEQ ID NO: 3734 - DNA, 229 bp, Homo sapiens
  chr11:31847484-31847713
  hyper
aaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaag

SEQ ID NO: 3735 - DNA, 104 bp, Homo sapiens
  chr11:31847769-31847873
  hyper
cggcctcggtggagcctcagggccagggcggggtgtggcggggtgtggcccggtggggtgagggagggacccggggtgcaagccaggccaaggcctcctcagtg

SEQ ID NO: 3736 - DNA, 76 bp, Homo sapiens
  chr11:31847895-31847971
  hyper
cgccccctcccaaggcgtggggtcccggggacagaccccgagcccctctctgcgcaactaccgcctctaaaaaaaa

SEQ ID NO: 3737 - DNA, 248 bp, Homo sapiens
  chr11:31848355-31848603
  hyper
cctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 3738 - DNA, 353 bp, Homo sapiens
  chr11:31848722-31849075
  hyper
cggacccggagcttgggaggcgaccgccaggctggtgcccggcctgacccggcgttcgcggccgcccgctcgcccgccgcgggccgggagcgtacaggagtgtgacgcagattgtgaaaacagaagggagggagttgggtcatttccttcgctaatcatcgccccctcctgctcctcctccccacccccatcccatcctcgccgccacccagcctcgaactctcttccttgccagagtctgcctcactttgagccagtggctgcactttatggagaaaatatatgtgcccatcactcacccatctatttgcagcgtccatggagcgcctcggggaacacgcatggacaattaa

SEQ ID NO: 3739 - DNA, 110 bp, Homo sapiens; identical to SEQ ID NO: 972
  chr11:32455906-32456016
  hyper

SEQ ID NO: 3740 - DNA, 154 bp, Homo sapiens
  chr11:32456758-32456912
  hyper
cgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgc

SEQ ID NO: 3741 - DNA, 156 bp, Homo sapiens
  chr11:32456913-32457069
  hyper
gcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactc

SEQ ID NO: 3742 - DNA, 916 bp, Homo sapiens
  chr11:32457851-32458767
  hyper
cttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccct

SEQ ID NO: 3743 - DNA, 155 bp, Homo sapiens
  chr11:33890297-33890452
  hyper
tactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccgg

SEQ ID NO: 3744 - DNA, 454 bp, Homo sapiens; identical to SEQ ID NO: 973
  chr11:43602393-43602847
  hyper

SEQ ID NO: 3745 - DNA, 189 bp, Homo sapiens; identical to SEQ ID NO: 974
  chr11:43602848-43603037
  hyper

SEQ ID NO: 3746 - DNA, 112 bp, Homo sapiens; identical to SEQ ID NO: 975
  chr11:43603076-43603188
  hyper

SEQ ID NO: 3747 - DNA, 40 bp, Homo sapiens
  chr11:43603446-43603486
  hyper
gtggtcatttttgaccgtaatgatccgattctgcaatatg

SEQ ID NO: 3748 - DNA, 81 bp, Homo sapiens; identical to SEQ ID NO: 976
  chr11:44330877-44330958
  hyper

SEQ ID NO: 3749 - DNA, 481 bp, Homo sapiens; identical to SEQ ID NO: 977
  chr11:44330959-44331440
  hyper

SEQ ID NO: 3750 - DNA, 229 bp, Homo sapiens; identical to SEQ ID NO: 978
  chr11:44331482-44331711
  hyper

SEQ ID NO: 3751 - DNA, 68 bp, Homo sapiens
  chr11:44341966-44342034
  hyper
ttcgtttacaggtcccggtcgagtttttcaaagggtggtggaaaacgcgcgcgcgagctctagtaaag

SEQ ID NO: 3752 - DNA, 194 bp, Homo sapiens
  chr11:45376858-45377052
  hyper
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagcc

SEQ ID NO: 3753 - DNA, 15 bp, Homo sapiens
  chr11:46316818-46316833
  hyper
gtaccattactgccc

SEQ ID NO: 3754 - DNA, 461 bp, Homo sapiens; identical to SEQ ID NO: 980
  chr11:46316895-46317356
  hyper

SEQ ID NO: 3755 - DNA, 290 bp, Homo sapiens; identical to SEQ ID NO: 981
  chr11:46317407-46317697
  hyper

SEQ ID NO: 3756 - DNA, 577 bp, Homo sapiens
  chr11:47208680-47209257
  hyper
ttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgc

SEQ ID NO: 3757 - DNA, 300 bp, Homo sapiens
  chr11:57194178-57194478
  hyper
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccga

SEQ ID NO: 3758 - DNA, 450 bp, Homo sapiens
  chr11:58672717-58673167
  hyper
aagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 3759 - DNA, 80 bp, Homo sapiens
  chr11:58673168-58673248
  hyper
ggggaggggatcgctgggaccgggatgggtcatctggacaaatagggagggtgggcgggtgggcgcgcagtcccctcggc

SEQ ID NO: 3760 - DNA, 153 bp, Homo sapiens; identical to SEQ ID NO: 982
  chr11:60718701-60718854
  hyper

SEQ ID NO: 3761 - DNA, 145 bp, Homo sapiens; identical to SEQ ID NO: 983
  chr11:60718976-60719121
  hyper

SEQ ID NO: 3762 - DNA, 348 bp, Homo sapiens
  chr11:61276772-61277120
  hyper
gctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcac

SEQ ID NO: 3763 - DNA, 15 bp, Homo sapiens
  chr11:61277327-61277342
  hyper
cgctccaggactggg

SEQ ID NO: 3764 - DNA, 274 bp, Homo sapiens
  chr11:61595049-61595323
  hyper
cgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctg

SEQ ID NO: 3765 - DNA, 762 bp, Homo sapiens; identical to SEQ ID NO: 984
  chr11:65600895-65601657
  hyper

SEQ ID NO: 3766 - DNA, 73 bp, Homo sapiens; identical to SEQ ID NO: 985
  chr11:65816447-65816520
  hyper

SEQ ID NO: 3767 - DNA, 4 bp, Homo sapiens
  chr11:65816560-65816564
  hyper
cggg

SEQ ID NO: 3768 - DNA, 75 bp, Homo sapiens; identical to SEQ ID NO: 987
  chr11:66188095-66188170
  hyper

SEQ ID NO: 3769 - DNA, 15 bp, Homo sapiens
  chr11:66188769-66188784
  hyper
gcacatcatgagcct

SEQ ID NO: 3770 - DNA, 257 bp, Homo sapiens
  chr11:66188852-66189109
  hyper
cgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagc

SEQ ID NO: 3771 - DNA, 165 bp, Homo sapiens
  chr11:71955215-71955380
  hyper
caagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcag

SEQ ID NO: 3772 - DNA, 176 bp, Homo sapiens
  chr11:78672891-78673067
  hyper
ctgatgtttccttctcgtgatgtctgtctgtgcatctttgtcggtacatctgcctgtccgatgtctctcatgggggttggggacagaagcagccctccaactcttgcacactccagcggcgccgcggggcaagagcggggctgcctgagcccgcggagccacgtcaggcccccagc

SEQ ID NO: 3773 - DNA, 549 bp, Homo sapiens
  chr11:82444635-82445184
  hyper
gagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttga

SEQ ID NO: 3774 - DNA, 76 bp, Homo sapiens
  chr11:86085786-86085862
  hyper
agcgagcctttctcgcgtcccagcaacgcgcccttccctctgccgggcctattctccctggtgcccctcccttcct

SEQ ID NO: 3775 - DNA, 60 bp, Homo sapiens
  chr11:86085931-86085991
  hyper
cggtgccggacatcagttcctgcggctcttgctgtgggagctgcccgagagccagagcag

SEQ ID NO: 3776 - DNA, 38 bp, Homo sapiens; identical to SEQ ID NO: 988
  chr11:88241938-88241976
  hyper

SEQ ID NO: 3777 - DNA, 145 bp, Homo sapiens; identical to SEQ ID NO: 989
  chr11:88242130-88242275
  hyper

SEQ ID NO: 3778 - DNA, 42 bp, Homo sapiens; identical to SEQ ID NO: 990
  chr11:88242358-88242400
  hyper

SEQ ID NO: 3779 - DNA, 111 bp, Homo sapiens
  chr11:88798820-88798931
  hyper
tttagccccagctcccgccccttgcttgattgctctccatccctgcactgggggaggggctccagcggtatcctatatccgtggtaactatagccaagagaaagaaaaagg

SEQ ID NO: 3780 - DNA, 170 bp, Homo sapiens
  chr11:88798965-88799135
  hyper
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccg

SEQ ID NO: 3781 - DNA, 120 bp, Homo sapiens
  chr11:91958730-91958850
  hyper
gcagccggtgcctctcgggcgcagtgggggatgttcagatgccgatggatgatgcacttaggggaccccgaggtgcaagttgggtcatcgctaggcgaggcgcggcgcagagagggagcc

SEQ ID NO: 3782 - DNA, 75 bp, Homo sapiens
  chr11:94473596-94473671
  hyper
ggagcgtgacggccacggtcgcctagcaacgagcggggatgcgcggggcgcctgggtgggcgaggggtgctcgcc

SEQ ID NO: 3783 - DNA, 97 bp, Homo sapiens
  chr11:94473672-94473769
  hyper
ccgccgccgcgcgccctcgggcccccgggaccgcgggaaaacttcgcggctcctcggcgctggggcgtcggcgccaggcccggcagacagagcaatg

SEQ ID NO: 3784 - DNA, 96 bp, Homo sapiens
  chr11:94473802-94473898
  hyper
cggcccagcgcccggccgggggagccgcggggtggcacgcggggaaagttggcgcgcgcctgaccgcgcctggaagccgcgcggtgccagggccga

SEQ ID NO: 3785 - DNA, 708 bp, Homo sapiens
  chr11:100997686-100998394
  hyper
aagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctgggg

SEQ ID NO: 3786 - DNA, 375 bp, Homo sapiens
  chr11:101453090-101453465
  hyper
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtccta

SEQ ID NO: 3787 - DNA, 345 bp, Homo sapiens
  chr11:104034409-104034754
  hyper
acaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctc

SEQ ID NO: 3788 - DNA, 463 bp, Homo sapiens
  chr11:104034755-104035218
  hyper
ccctgcgctggcccgggtcgctgtgctaatcgccgagctctccccaaacttcctgcatgctgaactttccgagcgcgtgtgggtgccgcacttccttgtggtgctgagctgataaatggtgacgggacaaacaacaggttgacgtttgtttgttcgccccctccggtggccggcagctgcagcacaggctgcagggggcgggcagcgccgaatctagcggggcaggcgagcggagcagcagcgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 3789 - DNA, 140 bp, Homo sapiens
  chr11:110582889-110583029
  hyper
gtcagggaagaggagcgccccggctgtccccctagagtctcctgctggggggacatcgcttccatgaagaaaatcttcaaacaaatcccagcccaggaggaggctacacgatcatgtccgcgggctgccggccggagggg

SEQ ID NO: 3790 - DNA, 853 bp, Homo sapiens
  chr11:110583043-110583896
  hyper
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaag

SEQ ID NO: 3791 - DNA, 383 bp, Homo sapiens
  chr11:111383132-111383515
  hyper
acccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggc

SEQ ID NO: 3792 - DNA, 16 bp, Homo sapiens
  chr11:111383516-111383532
  hyper
ggggtcccgctgggcc

SEQ ID NO: 3793 - DNA, 348 bp, Homo sapiens
  chr11:111383557-111383905
  hyper
cgcccagccatggtagggcgtcccccggtgaaatggggtccgaggcgggccccgaccccgcgtcggcgctgcggaccgtccgggagctgcagccgcgggtgcccggtgctcggtttgtaggcagtgtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 3794 - DNA, 286 bp, Homo sapiens; identical to SEQ ID NO: 991
  chr11:111411296-111411582
  hyper

SEQ ID NO: 3795 - DNA, 391 bp, Homo sapiens; identical to SEQ ID NO: 992
  chr11:111411821-111412212
  hyper

SEQ ID NO: 3796 - DNA, 38 bp, Homo sapiens; identical to SEQ ID NO: 993
  chr11:115530058-115530096
  hyper

SEQ ID NO: 3797 - DNA, 201 bp, Homo sapiens; identical to SEQ ID NO: 994
  chr11:115530221-115530422
  hyper

SEQ ID NO: 3798 - DNA, 50 bp, Homo sapiens
  chr11:115630424-115630474
  hyper
ctcgcctccccaatgcgcttcccgcctctgcatcgccgccggccccttca

SEQ ID NO: 3799 - DNA, 99 bp, Homo sapiens
  chr11:115630530-115630629
  hyper
cgaggtcgccggagctcctcctctcgcggctgagtgagggtctgggaggccagatgaagggagctgctcggctgagctgcggaccagcgcgagagcagc

SEQ ID NO: 3800 - DNA, 259 bp, Homo sapiens
  chr11:115630630-115630889
  hyper
ggcagtggcggaccagcgccagggcagggcaggggtggacagagggctctccccacccttccctcctccagtgaaagtaccagaagagatggcggccgctccgccgagtgtcattaccgcggaagcagcagaagccggcggcaggagcgggcccgagagcccgcggccagtggcctgcgcaccccgcgcccagcgcccccgccgcgggtcatcagtgtcagcgttgaggggtcccggggagcggttgcagggcggcggc

SEQ ID NO: 3801 - DNA, 94 bp, Homo sapiens
  chr11:115630890-115630984
  hyper
gcggccgggtcatcagaagcacagtggagccgccccctgctttgggaggagcaaaagagcctctcgcttgcctcccgctcgagctccttctcct

SEQ ID NO: 3802 - DNA, 57 bp, Homo sapiens
  chr11:115631307-115631364
  hyper
ctgctcttcagcaaacggtgtatttcagcccgagtttccttccgggggtttggctgt

SEQ ID NO: 3803 - DNA, 588 bp, Homo sapiens
  chr11:122847170-122847758
  hyper
gaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttga

SEQ ID NO: 3804 - DNA, 323 bp, Homo sapiens; identical to SEQ ID NO: 995
  chr11:122849801-122850124
  hyper

SEQ ID NO: 3805 - DNA, 232 bp, Homo sapiens; identical to SEQ ID NO: 996
  chr11:122850148-122850380
  hyper

SEQ ID NO: 3806 - DNA, 308 bp, Homo sapiens; identical to SEQ ID NO: 997
  chr11:122850901-122851209
  hyper

SEQ ID NO: 3807 - DNA, 15 bp, Homo sapiens
  chr11:123228701-123228716
  hyper
ctttccataccttcc

SEQ ID NO: 3808 - DNA, 392 bp, Homo sapiens; identical to SEQ ID NO: 999
  chr11:123228788-123229180
  hyper

SEQ ID NO: 3809 - DNA, 226 bp, Homo sapiens; identical to SEQ ID NO: 1000
  chr11:123229181-123229407
  hyper

SEQ ID NO: 3810 - DNA, 15 bp, Homo sapiens
  chr11:123301014-123301029
  hyper
actgcctcttcctcc

SEQ ID NO: 3811 - DNA, 944 bp, Homo sapiens; identical to SEQ ID NO: 1002
  chr11:123301082-123302026
  hyper

SEQ ID NO: 3812 - DNA, 181 bp, Homo sapiens; identical to SEQ ID NO: 1003
  chr11:125773880-125774061
  hyper

SEQ ID NO: 3813 - DNA, 312 bp, Homo sapiens; identical to SEQ ID NO: 1004
  chr11:125774122-125774434
  hyper

SEQ ID NO: 3814 - DNA, 330 bp, Homo sapiens
  chr11:128562856-128563186
  hyper
cagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtc

SEQ ID NO: 3815 - DNA, 37 bp, Homo sapiens
  chr11:128563336-128563373
  hyper
cggttttcgtccgagtcttccccggcagtaggcgctg

SEQ ID NO: 3816 - DNA, 167 bp, Homo sapiens
  chr11:128563669-128563836
  hyper
caagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggc

SEQ ID NO: 3817 - DNA, 500 bp, Homo sapiens
  chr11:128563896-128564396
  hyper
cctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccc

SEQ ID NO: 3818 - DNA, 189 bp, Homo sapiens; identical to SEQ ID NO: 1005
  chr11:128564685-128564874
  hyper

SEQ ID NO: 3819 - DNA, 2 bp, Homo sapiens
  chr11:128564875-128564877
  hyper
tc

SEQ ID NO: 3820 - DNA, 308 bp, Homo sapiens; identical to SEQ ID NO: 1007
  chr11:128564991-128565299
  hyper

SEQ ID NO: 3821 - DNA, 459 bp, Homo sapiens; identical to SEQ ID NO: 1008
  chr11:129242783-129243242
  hyper

SEQ ID NO: 3822 - DNA, 350 bp, Homo sapiens; identical to SEQ ID NO: 1009
  chr11:129243304-129243654
  hyper

SEQ ID NO: 3823 - DNA, 347 bp, Homo sapiens; identical to SEQ ID NO: 1010
  chr11:129243954-129244301
  hyper

SEQ ID NO: 3824 - DNA, 204 bp, Homo sapiens; identical to SEQ ID NO: 1011
  chr11:129244440-129244644
  hyper

SEQ ID NO: 3825 - DNA, 203 bp, Homo sapiens; identical to SEQ ID NO: 1012
  chr11:131780876-131781079
  hyper

SEQ ID NO: 3826 - DNA, 449 bp, Homo sapiens; identical to SEQ ID NO: 1013
  chr11:132952552-132953001
  hyper

SEQ ID NO: 3827 - DNA, 263 bp, Homo sapiens
  chr11:133825226-133825489
  hyper
aacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctc

SEQ ID NO: 3828 - DNA, 151 bp, Homo sapiens
  chr11:133906799-133906950
  hyper
gtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactct

SEQ ID NO: 3829 - DNA, 16 bp, Homo sapiens
  chr11:133938772-133938788
  hyper
agagaacccatgtgcc

SEQ ID NO: 3830 - DNA, 275 bp, Homo sapiens
  chr11:133938789-133939064
  hyper
gtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggtgagtttgc

SEQ ID NO: 3831 - DNA, 316 bp, Homo sapiens
  chr11:133939065-133939381
  hyper
cgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgt

SEQ ID NO: 3832 - DNA, 774 bp, Homo sapiens; identical to SEQ ID NO: 1014
  chr11:134145653-134146427
  hyper

SEQ ID NO: 3833 - DNA, 232 bp, Homo sapiens; identical to SEQ ID NO: 1015
  chr11:134146444-134146676
  hyper

SEQ ID NO: 3834 - DNA, 217 bp, Homo sapiens; identical to SEQ ID NO: 1016
  chr11:134146677-134146894
  hyper

SEQ ID NO: 3835 - DNA, 244 bp, Homo sapiens
  chr12:1639107-1639351
  hyper
cgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcg

SEQ ID NO: 3836 - DNA, 285 bp, Homo sapiens
  chr12:2162554-2162839
  hyper
tgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgcccta

SEQ ID NO: 3837 - DNA, 400 bp, Homo sapiens
  chr12:2163110-2163510
  hyper
ggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 3838 - DNA, 61 bp, Homo sapiens
  chr12:3600168-3600229
  hyper
cgggcctggcctccacgtaagttgtgtgcagcgccagggagtggaggcggccgagaccctc

SEQ ID NO: 3839 - DNA, 115 bp, Homo sapiens
  chr12:3600230-3600345
  hyper
gagactaggggagggggcgggcccgggggcgctgggggccctcggtctgcgcccagccgccgccggctccagcgaacctcctaccccgcccccactcacccggctcagcccctag

SEQ ID NO: 3840 - DNA, 555 bp, Homo sapiens
  chr12:3602162-3602717
  hyper
gagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcg

SEQ ID NO: 3841 - DNA, 15 bp, Homo sapiens
  chr12:3602864-3602879
  hyper
cgctcccccttctca

SEQ ID NO: 3842 - DNA, 335 bp, Homo sapiens; identical to SEQ ID NO: 1017
  chr12:4274054-4274389
  hyper

SEQ ID NO: 3843 - DNA, 808 bp, Homo sapiens; identical to SEQ ID NO: 1018
  chr12:5017990-5018798
  hyper

SEQ ID NO: 3844 - DNA, 6 bp, Homo sapiens
  chr12:5018799-5018805
  hyper
cgagcc

SEQ ID NO: 3845 - DNA, 229 bp, Homo sapiens; identical to SEQ ID NO: 1020
  chr12:5018806-5019035
  hyper

SEQ ID NO: 3846 - DNA, 659 bp, Homo sapiens; identical to SEQ ID NO: 1021
  chr12:5019084-5019743
  hyper

SEQ ID NO: 3847 - DNA, 397 bp, Homo sapiens; identical to SEQ ID NO: 1022
  chr12:5019793-5020190
  hyper

SEQ ID NO: 3848 - DNA, 712 bp, Homo sapiens
  chr12:5542090-5542802
  hyper
gcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggacta

SEQ ID NO: 3849 - DNA, 153 bp, Homo sapiens
  chr12:6664370-6664523
  hyper
cgttgtgagtggtatgacacagagagacctgtccccctttcccaatccctacctccgcttgtactcgtcccgctcccgcttcactttggccagcacgttgtagagagcgcggatctcgggcgtgatggtgtcgatctggacgcccaccccatc

SEQ ID NO: 3850 - DNA, 424 bp, Homo sapiens
  chr12:8171321-8171745
  hyper
gcccggcagtgacagcgaccgcgccgctgcgctcccgccggccccgcccgcagccgctgggacccactaactgcctcgaaaagcctaggattcgactttgaatggtccgttaatgtggtcgcaaaacgtgactcggttcatcgggcgctccctgtaagcaagacaagcacccacctgcggtcagagcaggggtccggctcgcggtcggggttgtccaggccctcccggcttctcacctgcgcaccacacggtccagccctggcggctgcaggggatccctccgagcgccccctcaggcgtcttcctgcgaccggggagagggaaccctttacggggaaacagttttggggcccaccacccttggcgccgccgttaggagggtgtgaacatttctgctttaagagatacccgagcccctcaccgc

SEQ ID NO: 3851 - DNA, 68 bp, Homo sapiens; identical to SEQ ID NO: 1023
  chr12:14133813-14133881
  hyper

SEQ ID NO: 3852 - DNA, 777 bp, Homo sapiens
  chr12:14134478-14135255
  hyper
gcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 3853 - DNA, 71 bp, Homo sapiens; identical to SEQ ID NO: 1024
  chr12:22093889-22093960
  hyper

SEQ ID NO: 3854 - DNA, 308 bp, Homo sapiens; identical to SEQ ID NO: 1025
  chr12:22093961-22094269
  hyper

SEQ ID NO: 3855 - DNA, 471 bp, Homo sapiens; identical to SEQ ID NO: 1026
  chr12:22094577-22095048
  hyper

SEQ ID NO: 3856 - DNA, 83 bp, Homo sapiens; identical to SEQ ID NO: 1027
  chr12:22486799-22486882
  hyper

SEQ ID NO: 3857 - DNA, 300 bp, Homo sapiens; identical to SEQ ID NO: 1028
  chr12:22487133-22487433
  hyper

SEQ ID NO: 3858 - DNA, 194 bp, Homo sapiens
  chr12:25056242-25056436
  hyper
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtct

SEQ ID NO: 3859 - DNA, 601 bp, Homo sapiens
  chr12:25101397-25101998
  hyper
cctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcc

SEQ ID NO: 3860 - DNA, 77 bp, Homo sapiens
  chr12:25102009-25102086
  hyper
cgagtacacgtggcgggctggattgcagaccggccctctcgcggcggagactcgcgacctagcggattgcatcagca

SEQ ID NO: 3861 - DNA, 372 bp, Homo sapiens
  chr12:28128699-28129071
  hyper
agtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccg

SEQ ID NO: 3862 - DNA, 23 bp, Homo sapiens
  chr12:30322902-30322925
  hyper
cccagcagagcgaggcgctgggc

SEQ ID NO: 3863 - DNA, 426 bp, Homo sapiens
  chr12:30323014-30323440
  hyper
cggccccggctatcaacacctcctcctccccactgcgaatgccccgatcgtgctccccaaaacccaatacatccacgcccccaaaaaactgggaacccacgcgggtgccttctgtttaccgcagcgctctcactgcaggcgcttgagtaccagatggcgagagttcgcgcgcaggtggagtggggatcctggcgctaggctacccaggagaggaggggaagggcaacccgcggtcccgcctgtggtgcccggctgtgctcatccccacgccccagaccccaaaaggggctggggaggggcacatctggcggacccctcgcgggggaccaagcgggtttagcaggtgcgccgcctggaacccctacgcccaccttccagggagaaaagtgcctctgcttctcgggaagttcccggcttttcagcacc

SEQ ID NO: 3864 - DNA, 24 bp, Homo sapiens
  chr12:30323502-30323526
  hyper
cgccagcttcgtgatcttctgccc

SEQ ID NO: 3865 - DNA, 533 bp, Homo sapiens
  chr12:30975388-30975921
  hyper
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctggg

SEQ ID NO: 3866 - DNA, 100 bp, Homo sapiens
  chr12:31079268-31079368
  hyper
ctaagcggggagctgcggagcgcggggagtttgaaagccgctccaccgccctactagtccgtccttttgccccgccccccttagggatccccccggcaac

SEQ ID NO: 3867 - DNA, 247 bp, Homo sapiens
  chr12:31079417-31079664
  hyper
cgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccc

SEQ ID NO: 3868 - DNA, 117 bp, Homo sapiens
  chr12:31079693-31079810
  hyper
cgcagctcccttcgccgcttccggagcccctggcagggtaagtgcagaagcgcgcccgaggagtgggggcgccgcgggagggggctgggggtccaggagaggcgcctccacctccgc

SEQ ID NO: 3869 - DNA, 96 bp, Homo sapiens
  chr12:47225381-47225477
  hyper
atccagctctgctctcgccttctcccttgaaagagactccttgggggctccccaggtcagagtaccccgcccggggaatcatgctggtctctgggg

SEQ ID NO: 3870 - DNA, 65 bp, Homo sapiens
  chr12:47225550-47225615
  hyper
cgggtccagggactcgggtaacaccttgccagcaggatcccgggcggtcgcggagccagctcccg

SEQ ID NO: 3871 - DNA, 1227 bp, Homo sapiens; identical to SEQ ID NO: 1029
  chr12:48397123-48398350
  hyper

SEQ ID NO: 3872 - DNA, 113 bp, Homo sapiens
  chr12:49297802-49297915
  hyper
gaccctctcaaaaaccgaccgcggtcctccactgggtagggggcgctccaagacagggactcttctagcctgttgcctctccatgttagcgatatcctcgttgctaggagact

SEQ ID NO: 3873 - DNA, 90 bp, Homo sapiens; identical to SEQ ID NO: 1030
  chr12:49374937-49375027
  hyper

SEQ ID NO: 3874 - DNA, 57 bp, Homo sapiens; identical to SEQ ID NO: 1031
  chr12:49375115-49375172
  hyper

SEQ ID NO: 3875 - DNA, 255 bp, Homo sapiens; identical to SEQ ID NO: 1032
  chr12:49390850-49391105
  hyper

SEQ ID NO: 3876 - DNA, 788 bp, Homo sapiens; identical to SEQ ID NO: 1033
  chr12:49391146-49391934
  hyper

SEQ ID NO: 3877 - DNA, 634 bp, Homo sapiens; identical to SEQ ID NO: 1034
  chr12:49729728-49730362
  hyper

SEQ ID NO: 3878 - DNA, 94 bp, Homo sapiens; identical to SEQ ID NO: 1035
  chr12:50297461-50297555
  hyper

SEQ ID NO: 3879 - DNA, 115 bp, Homo sapiens; identical to SEQ ID NO: 1036
  chr12:50297973-50298088
  hyper

SEQ ID NO: 3880 - DNA, 198 bp, Homo sapiens
  chr12:52400709-52400907
  hyper
gacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctcc

SEQ ID NO: 3881 - DNA, 508 bp, Homo sapiens
  chr12:52400908-52401416
  hyper
gtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagaca

SEQ ID NO: 3882 - DNA, 79 bp, Homo sapiens; identical to SEQ ID NO: 1037
  chr12:52652141-52652220
  hyper

SEQ ID NO: 3883 - DNA, 14 bp, Homo sapiens
  chr12:52652599-52652613
  hyper
gagtggaacccctc

SEQ ID NO: 3884 - DNA, 15 bp, Homo sapiens
  chr12:53359301-53359316
  hyper
tagggagctgctccc

SEQ ID NO: 3885 - DNA, 178 bp, Homo sapiens
  chr12:53359385-53359563
  hyper
cgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctggga

SEQ ID NO: 3886 - DNA, 378 bp, Homo sapiens; identical to SEQ ID NO: 1039
  chr12:54321250-54321628
  hyper

SEQ ID NO: 3887 - DNA, 114 bp, Homo sapiens
  chr12:54338704-54338818
  hyper
gtgcctaggcagcctcgggtcctctatctcagtccagccgcttgcctcacttcttcccgcttgccttatctccccgcagacgtggttcccctgcagcccgaggtgagcagctac

SEQ ID NO: 3888 - DNA, 17 bp, Homo sapiens
  chr12:54338978-54338995
  hyper
ggcgggtcaaagagaag

SEQ ID NO: 3889 - DNA, 48 bp, Homo sapiens; identical to SEQ ID NO: 1040
  chr12:54345611-54345659
  hyper

SEQ ID NO: 3890 - DNA, 14 bp, Homo sapiens
  chr12:54345965-54345979
  hyper
ggtgggtctcaggg

SEQ ID NO: 3891 - DNA, 180 bp, Homo sapiens; identical to SEQ ID NO: 1042
  chr12:54354514-54354694
  hyper

SEQ ID NO: 3892 - DNA, 38 bp, Homo sapiens; identical to SEQ ID NO: 1043
  chr12:54354814-54354852
  hyper

SEQ ID NO: 3893 - DNA, 43 bp, Homo sapiens; identical to SEQ ID NO: 1044
  chr12:54379888-54379931
  hyper

SEQ ID NO: 3894 - DNA, 406 bp, Homo sapiens; identical to SEQ ID NO: 1045
  chr12:54379958-54380364
  hyper

SEQ ID NO: 3895 - DNA, 120 bp, Homo sapiens
  chr12:54402676-54402796
  hyper
tcatgtcgtggattgatgaacgcgaatcgcgtgtaagcgccgccaccgccgggagtctgaggaattcgcctgggctgttagaggaaagagctaagtgagagagcgcgagctctacctacc

SEQ ID NO: 3896 - DNA, 504 bp, Homo sapiens
  chr12:54402856-54403360
  hyper
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagt

SEQ ID NO: 3897 - DNA, 553 bp, Homo sapiens
  chr12:54812069-54812622
  hyper
cagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 3898 - DNA, 14 bp, Homo sapiens
  chr12:57619110-57619124
  hyper
gggcctgtccccca

SEQ ID NO: 3899 - DNA, 340 bp, Homo sapiens
  chr12:57943845-57944185
  hyper
gacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggt

SEQ ID NO: 3900 - DNA, 166 bp, Homo sapiens
  chr12:58021293-58021459
  hyper
ccgctggcggctgggcgcgggtgcagcctaggaggagaggcgcgtgaccgtgcgccagctccccgtggggctcctgccagggtcgaccgggagggggtgccactcacccagatgagccacgcggctgaggcgggggtcgaaaccgacctcgcgcaccttgtcagtc

SEQ ID NO: 3901 - DNA, 88 bp, Homo sapiens; identical to SEQ ID NO: 1046
  chr12:58025646-58025734
  hyper

SEQ ID NO: 3902 - DNA, 190 bp, Homo sapiens; identical to SEQ ID NO: 1047
  chr12:62584823-62585013
  hyper

SEQ ID NO: 3903 - DNA, 963 bp, Homo sapiens; identical to SEQ ID NO: 1048
  chr12:62585030-62585993
  hyper

SEQ ID NO: 3904 - DNA, 462 bp, Homo sapiens
  chr12:63543848-63544310
  hyper
gctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaa

SEQ ID NO: 3905 - DNA, 88 bp, Homo sapiens; identical to SEQ ID NO: 1049
  chr12:63544512-63544600
  hyper

SEQ ID NO: 3906 - DNA, 146 bp, Homo sapiens; identical to SEQ ID NO: 1050
  chr12:63544728-63544874
  hyper

SEQ ID NO: 3907 - DNA, 165 bp, Homo sapiens
  chr12:64061785-64061950
  hyper
aagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtct

SEQ ID NO: 3908 - DNA, 232 bp, Homo sapiens; identical to SEQ ID NO: 1051
  chr12:65218319-65218551
  hyper

SEQ ID NO: 3909 - DNA, 281 bp, Homo sapiens; identical to SEQ ID NO: 1052
  chr12:65218900-65219181
  hyper

SEQ ID NO: 3910 - DNA, 179 bp, Homo sapiens; identical to SEQ ID NO: 1053
  chr12:65219605-65219784
  hyper

SEQ ID NO: 3911 - DNA, 327 bp, Homo sapiens
  chr12:65220112-65220439
  hyper
ctatgagaaggcaatcggcatgatgcccagcaggtgccccggaaaagtcagaagagcatattggtcagacatacagggaatccttgtagtgtggcaagaataagtcagcgcgggaccgaatttcctggtctttgttatcaagcaaacgtcatgattatacgctcctccattcagcacctcgcgtccggacagcaacctcacttgttttcagcgtgccttaaagcgtgcgctgggctggaaacactcccgtggccgttgttatcaccgttctatgtttgggcaggacttcgtttaaaccacctcagagagaggcggatccatgtggta

SEQ ID NO: 3912 - DNA, 200 bp, Homo sapiens
  chr12:65514835-65515035
  hyper
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccg

SEQ ID NO: 3913 - DNA, 139 bp, Homo sapiens
  chr12:66123380-66123519
  hyper
gggaggtggagcacgaaacacaaaagctgtttgaaccacaaacgccaggctggacacccaacgaatattaatgacctgcagcctccacccacccgcaaacataatattatgtgtacgtgcttaccggttagcttaacag

SEQ ID NO: 3914 - DNA, 122 bp, Homo sapiens
  chr12:72666686-72666808
  hyper
cttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 3915 - DNA, 389 bp, Homo sapiens
  chr12:72666997-72667386
  hyper
cgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaaggtatggagggaggcggtgccccgcgctgccccaccccggcgcgcggctc

SEQ ID NO: 3916 - DNA, 38 bp, Homo sapiens
  chr12:72667387-72667425
  hyper
aacctctgggcggcctgcgaccccggggacccagctgg

SEQ ID NO: 3917 - DNA, 20 bp, Homo sapiens
  chr12:75601480-75601500
  hyper
ggtcgctggccctgccgccg

SEQ ID NO: 3918 - DNA, 247 bp, Homo sapiens; identical to SEQ ID NO: 1055
  chr12:75601695-75601942
  hyper

SEQ ID NO: 3919 - DNA, 194 bp, Homo sapiens
  chr12:81102236-81102430
  hyper
accccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaat

SEQ ID NO: 3920 - DNA, 375 bp, Homo sapiens
  chr12:85673460-85673835
  hyper
ttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctg

SEQ ID NO: 3921 - DNA, 224 bp, Homo sapiens
  chr12:93966429-93966653
  hyper
actgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtcttt

SEQ ID NO: 3922 - DNA, 149 bp, Homo sapiens
  chr12:93967067-93967216
  hyper
agatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccggg

SEQ ID NO: 3923 - DNA, 14 bp, Homo sapiens
  chr12:95942964-95942978
  hyper
gcgtggcaaactcc

SEQ ID NO: 3924 - DNA, 107 bp, Homo sapiens
  chr12:99288301-99288408
  hyper
cgactcggcttcctccgcctctgccccggctgcggcaccacttcttggagccacgtctcggcgagcgggggccgcggagcgagggggccgctgtgccgctactcacc

SEQ ID NO: 3925 - DNA, 155 bp, Homo sapiens
  chr12:99288782-99288937
  hyper
cggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagag

SEQ ID NO: 3926 - DNA, 1 bp, Homo sapiens
  chr12:99288961-99288962
  hyper
c

SEQ ID NO: 3927 - DNA, 93 bp, Homo sapiens
  chr12:99289161-99289254
  hyper
ggctcggcagcggcagagcagtggcagcagccgccactgccgctgttactgcggtcgccgccgctggagagaggaggacgaggagggcaaggg

SEQ ID NO: 3928 - DNA, 485 bp, Homo sapiens; identical to SEQ ID NO: 1057
  chr12:103351501-103351986
  hyper

SEQ ID NO: 3929 - DNA, 104 bp, Homo sapiens; identical to SEQ ID NO: 1058
  chr12:103352051-103352155
  hyper

SEQ ID NO: 3930 - DNA, 97 bp, Homo sapiens; identical to SEQ ID NO: 1059
  chr12:103352170-103352267
  hyper

SEQ ID NO: 3931 - DNA, 15 bp, Homo sapiens
  chr12:103352268-103352283
  hyper
cccaagcaagtcaag

SEQ ID NO: 3932 - DNA, 259 bp, Homo sapiens; identical to SEQ ID NO: 1061
  chr12:103352313-103352572
  hyper

SEQ ID NO: 3933 - DNA, 263 bp, Homo sapiens; identical to SEQ ID NO: 1062
  chr12:103889253-103889516
  hyper

SEQ ID NO: 3934 - DNA, 197 bp, Homo sapiens; identical to SEQ ID NO: 1063
  chr12:103889517-103889714
  hyper

SEQ ID NO: 3935 - DNA, 24 bp, Homo sapiens
  chr12:103889788-103889812
  hyper
cgcagtcgccgggcaaccacaatg

SEQ ID NO: 3936 - DNA, 78 bp, Homo sapiens; identical to SEQ ID NO: 1065
  chr12:104609448-104609526
  hyper

SEQ ID NO: 3937 - DNA, 270 bp, Homo sapiens; identical to SEQ ID NO: 1066
  chr12:104609527-104609797
  hyper

SEQ ID NO: 3938 - DNA, 628 bp, Homo sapiens; identical to SEQ ID NO: 1067
  chr12:106980911-106981539
  hyper

SEQ ID NO: 3939 - DNA, 492 bp, Homo sapiens; identical to SEQ ID NO: 1068
  chr12:108168922-108169414
  hyper

SEQ ID NO: 3940 - DNA, 34 bp, Homo sapiens; identical to SEQ ID NO: 1069
  chr12:108169549-108169583
  hyper

SEQ ID NO: 3941 - DNA, 255 bp, Homo sapiens
  chr12:108238259-108238514
  hyper
gagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 3942 - DNA, 553 bp, Homo sapiens
  chr12:111471407-111471960
  hyper
gcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtg

SEQ ID NO: 3943 - DNA, 138 bp, Homo sapiens
  chr12:111472058-111472196
  hyper
cgccggccgcgcggccgtgaggagcccccgggcgcgccctgggcgcattggggaggtccccgggcgggcaggcggacgccctggggcggcgggcggcggctgccggggctcgccggggctcggccgcccgctgcccat

SEQ ID NO: 3944 - DNA, 161 bp, Homo sapiens
  chr12:111472356-111472517
  hyper
cgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcgggcagg

SEQ ID NO: 3945 - DNA, 95 bp, Homo sapiens
  chr12:111472577-111472672
  hyper
gaggcggctccgcgccccgccgctcgccggcacctcagccttcgccgcccgcctggctgcgcagcccggacgcgccgccacccgggggccgccgc

SEQ ID NO: 3946 - DNA, 166 bp, Homo sapiens
  chr12:111472851-111473017
  hyper
cgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttct

SEQ ID NO: 3947 - DNA, 325 bp, Homo sapiens; identical to SEQ ID NO: 1070
  chr12:113012954-113013279
  hyper

SEQ ID NO: 3948 - DNA, 79 bp, Homo sapiens; identical to SEQ ID NO: 1071
  chr12:113541522-113541601
  hyper

SEQ ID NO: 3949 - DNA, 438 bp, Homo sapiens; identical to SEQ ID NO: 1072
  chr12:113541661-113542099
  hyper

SEQ ID NO: 3950 - DNA, 401 bp, Homo sapiens; identical to SEQ ID NO: 1073
  chr12:113900758-113901159
  hyper

SEQ ID NO: 3951 - DNA, 24 bp, Homo sapiens
  chr12:113901407-113901431
  hyper
cgaagtaggcgggggacccgggac

SEQ ID NO: 3952 - DNA, 332 bp, Homo sapiens
  chr12:113913350-113913682
  hyper
gggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 3953 - DNA, 358 bp, Homo sapiens
  chr12:114838380-114838738
  hyper
tctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctccc

SEQ ID NO: 3954 - DNA, 116 bp, Homo sapiens
  chr12:114844184-114844300
  hyper
acaaatcatttcaaacgcggtcggcttctaatcgggaagtaatctcagtgacgctggcggtgcagagaaccgagtctggacgcacacacacaaacacaccgcgggcctccgcagcc

SEQ ID NO: 3955 - DNA, 476 bp, Homo sapiens
  chr12:114846471-114846947
  hyper
cgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 3956 - DNA, 122 bp, Homo sapiens
  chr12:114847042-114847164
  hyper
cgggcagcttccagcgccggccacaagctcccaggccagctgggccgcagacccctttgcttccagagagcacaacccgcgtcctttctctcagccaggctgcagtggctgccccgagcttc

SEQ ID NO: 3957 - DNA, 272 bp, Homo sapiens
  chr12:114847165-114847437
  hyper
ctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggac

SEQ ID NO: 3958 - DNA, 78 bp, Homo sapiens
  chr12:114847577-114847655
  hyper
cgggcagtaaactccggagccggctacagcgcgcatcctcccttcctcctttcggagaactgtcgctttcccgaagct

SEQ ID NO: 3959 - DNA, 131 bp, Homo sapiens
  chr12:117799330-117799461
  hyper
cgctgctcgctgcccggccgcccctcggaggagccgcggcgctaagtagctcctcacccagcggctggaaacgcggcataaatatgtagggactgagccgtgagctcagcgagggtcgtgagggggaattt

SEQ ID NO: 3960 - DNA, 58 bp, Homo sapiens
  chr12:119212142-119212200
  hyper
ttgtttgtccttgaacgcggcagggagtggaggaaggcgccgggaggaggcacaaaat

SEQ ID NO: 3961 - DNA, 63 bp, Homo sapiens
  chr12:119212318-119212381
  hyper
cgctgctgaaatgcaatggacaaaagggagaggaatggccgcatcttccggctgcccgttgct

SEQ ID NO: 3962 - DNA, 364 bp, Homo sapiens
  chr12:120032837-120033201
  hyper
ctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcacca

SEQ ID NO: 3963 - DNA, 153 bp, Homo sapiens
  chr12:128752114-128752267
  hyper
cgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccacccc

SEQ ID NO: 3964 - DNA, 53 bp, Homo sapiens; identical to SEQ ID NO: 1075
  chr12:129337857-129337910
  hyper

SEQ ID NO: 3965 - DNA, 239 bp, Homo sapiens; identical to SEQ ID NO: 1076
  chr12:129338587-129338826
  hyper

SEQ ID NO: 3966 - DNA, 55 bp, Homo sapiens; identical to SEQ ID NO: 1077
  chr12:129338851-129338906
  hyper

SEQ ID NO: 3967 - DNA, 156 bp, Homo sapiens
  chr12:130388279-130388435
  hyper
gctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgc

SEQ ID NO: 3968 - DNA, 140 bp, Homo sapiens
  chr12:130389012-130389152
  hyper
cgtcatcaaaacctcaggcccaggggaggtcctccagcccgggggcacctgaggctcttcgccagggagagcgcaaggatggctggagaagggccctcgccccgccctgcgcatctcccagggatcgcagtgaggaagtc

SEQ ID NO: 3969 - DNA, 120 bp, Homo sapiens; identical to SEQ ID NO: 1078
  chr12:130647950-130648070
  hyper

SEQ ID NO: 3970 - DNA, 15 bp, Homo sapiens
  chr12:133481368-133481383
  hyper
gaagcttttcctcac

SEQ ID NO: 3971 - DNA, 31 bp, Homo sapiens; identical to SEQ ID NO: 1080
  chr12:133481489-133481520
  hyper

SEQ ID NO: 3972 - DNA, 134 bp, Homo sapiens; identical to SEQ ID NO: 1081
  chr12:133481521-133481655
  hyper

SEQ ID NO: 3973 - DNA, 187 bp, Homo sapiens; identical to SEQ ID NO: 1082
  chr12:133485161-133485348
  hyper

SEQ ID NO: 3974 - DNA, 251 bp, Homo sapiens; identical to SEQ ID NO: 1083
  chr12:133485439-133485690
  hyper

SEQ ID NO: 3975 - DNA, 481 bp, Homo sapiens; identical to SEQ ID NO: 1084
  chr13:23733629-23734110
  hyper

SEQ ID NO: 3976 - DNA, 75 bp, Homo sapiens; identical to SEQ ID NO: 1085
  chr13:25319830-25319905
  hyper

SEQ ID NO: 3977 - DNA, 70 bp, Homo sapiens
  chr13:25320387-25320457
  hyper
cgcagctcctgatgccaagttcacttggaccccggctgagattagagaggcctggcgaggtgtgggggtg

SEQ ID NO: 3978 - DNA, 295 bp, Homo sapiens; identical to SEQ ID NO: 1086
  chr13:25320734-25321029
  hyper

SEQ ID NO: 3979 - DNA, 1072 bp, Homo sapiens; identical to SEQ ID NO: 1087
  chr13:25321112-25322184
  hyper

SEQ ID NO: 3980 - DNA, 26 bp, Homo sapiens
  chr13:25744709-25744735
  hyper
aggcagggtctggggcggcgggcgcc

SEQ ID NO: 3981 - DNA, 295 bp, Homo sapiens; identical to SEQ ID NO: 1089
  chr13:25745300-25745595
  hyper

SEQ ID NO: 3982 - DNA, 221 bp, Homo sapiens; identical to SEQ ID NO: 1090
  chr13:25745726-25745947
  hyper

SEQ ID NO: 3983 - DNA, 54 bp, Homo sapiens; identical to SEQ ID NO: 1091
  chr13:25946620-25946674
  hyper

SEQ ID NO: 3984 - DNA, 18 bp, Homo sapiens
  chr13:25946801-25946819
  hyper
cggcgcagagaagatgca

SEQ ID NO: 3985 - DNA, 403 bp, Homo sapiens
  chr13:26042768-26043171
  hyper
cgcccaccccggcccgacaagcagcttgggcgtccagcccggcccggtccctgcagggagggagcgcaggagctgggggcggctctcccggggcggggctcgctccacaagcgccaggggccgcgcggggcgtgggcgtgggcggggccgggggcggggccggccttggctgccgcggcacaggcggcggcgtctccagggggagccaaggtacgtaggcggcgtccgcctcacccgagcatccttccccgccggtggccgcccgcccgcggcccgcgctcgcagcctcccgcctggcggttgacttctttgtgtcgtattctctgcctgcgccctgtctctgcaggacctgttcgttcttctttgggctataagaaggcagaggatgagatgtcccgggcca

SEQ ID NO: 3986 - DNA, 159 bp, Homo sapiens
  chr13:26043340-26043499
  hyper
cgcgcacctggccggcccccgtccatctcccccagagccttcccctgccccctccccaccccactagcccgcggtgcagccccgcgcttccagtagggtcatgcgaatgcagccctcaccgttctctcctgcgcatccgttctgcgcccagcctgcctc

SEQ ID NO: 3987 - DNA, 419 bp, Homo sapiens
  chr13:27334304-27334723
  hyper
cttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 3988 - DNA, 238 bp, Homo sapiens
  chr13:27334724-27334962
  hyper
cccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcg

SEQ ID NO: 3989 - DNA, 91 bp, Homo sapiens
  chr13:28365659-28365750
  hyper
gcagcggtttcccagcgcactgctggaagtgtgctccagtagacagggtgtgggcaagatgcgcgggcagacagtccgcactcgccacatg

SEQ ID NO: 3990 - DNA, 95 bp, Homo sapiens; identical to SEQ ID NO: 1093
  chr13:28366482-28366577
  hyper

SEQ ID NO: 3991 - DNA, 152 bp, Homo sapiens; identical to SEQ ID NO: 1094
  chr13:28367794-28367946
  hyper

SEQ ID NO: 3992 - DNA, 84 bp, Homo sapiens; identical to SEQ ID NO: 1095
  chr13:28368153-28368237
  hyper

SEQ ID NO: 3993 - DNA, 77 bp, Homo sapiens; identical to SEQ ID NO: 1096
  chr13:28368994-28369071
  hyper

SEQ ID NO: 3994 - DNA, 850 bp, Homo sapiens; identical to SEQ ID NO: 1097
  chr13:28369161-28370011
  hyper

SEQ ID NO: 3995 - DNA, 382 bp, Homo sapiens
  chr13:28370980-28371362
  hyper
gctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagtttt

SEQ ID NO: 3996 - DNA, 402 bp, Homo sapiens
  chr13:28395255-28395657
  hyper
gttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtggctttgcaaaagcagccgctgcgattctctagcgccagcgcccctgcttccaggaactttacgcaagataggcgagaggggtggccgcactaaaagaaaaagaaaaattaaaaaaaaagacattccaactactttatccttgcgcagggaccccttc

SEQ ID NO: 3997 - DNA, 196 bp, Homo sapiens
  chr13:28491793-28491989
  hyper
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatatta

SEQ ID NO: 3998 - DNA, 181 bp, Homo sapiens
  chr13:28492244-28492425
  hyper
caagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgccc

SEQ ID NO: 3999 - DNA, 127 bp, Homo sapiens
  chr13:28492426-28492553
  hyper
ggccccacggcctttcactctctgcccccaccaaaactgcaggtggcacttttccctgaagaaatcaccgaaactctccccgcccgccgccgtgcttcccttggcctgtcttcggtgacagcaaggg

SEQ ID NO: 4000 - DNA, 195 bp, Homo sapiens
  chr13:28544390-28544585
  hyper
ctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 4001 - DNA, 217 bp, Homo sapiens
  chr13:28544665-28544882
  hyper
cgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgt

SEQ ID NO: 4002 - DNA, 395 bp, Homo sapiens
  chr13:28549497-28549892
  hyper
gaggaggccccattccgtatcccagttaagttacacaggtgagtgacaagcccgggtcggctcctgagttctcatccggagctgcgctctcccgtctctttactgggagcgttctcctgccggggcttggacatttccaagggaagtgaaaatccacaaagctgcccccacttcgtaagggcctgtgcctggagggtcgtcgggttacagaaattgaaatcagctctttgccttccaactcttcttggccttgccaccgcgattggttttgttttctttgtttttaacgaattggtaagtaaaatattagttgttcaccctgaaatctgccctaaccacttccgtaccccctgaagctcgctgggcgcgccctgggctgtccttccctgagcagc

SEQ ID NO: 4003 - DNA, 264 bp, Homo sapiens
  chr13:28551285-28551549
  hyper
tgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctc

SEQ ID NO: 4004 - DNA, 37 bp, Homo sapiens
  chr13:28551658-28551695
  hyper
cgcagggctcttcccggcccaccgcctccttcctgcg

SEQ ID NO: 4005 - DNA, 171 bp, Homo sapiens; identical to SEQ ID NO: 1098
  chr13:28674056-28674227
  hyper

SEQ ID NO: 4006 - DNA, 436 bp, Homo sapiens; identical to SEQ ID NO: 1099
  chr13:28674720-28675156
  hyper

SEQ ID NO: 4007 - DNA, 1213 bp, Homo sapiens; identical to SEQ ID NO: 1100
  chr13:29067773-29068986
  hyper

SEQ ID NO: 4008 - DNA, 182 bp, Homo sapiens; identical to SEQ ID NO: 1101
  chr13:29068993-29069175
  hyper

SEQ ID NO: 4009 - DNA, 114 bp, Homo sapiens; identical to SEQ ID NO: 1102
  chr13:29106308-29106422
  hyper

SEQ ID NO: 4010 - DNA, 392 bp, Homo sapiens; identical to SEQ ID NO: 1103
  chr13:29106423-29106815
  hyper

SEQ ID NO: 4011 - DNA, 60 bp, Homo sapiens; identical to SEQ ID NO: 1104
  chr13:29106898-29106958
  hyper

SEQ ID NO: 4012 - DNA, 212 bp, Homo sapiens
  chr13:33591219-33591431
  hyper
ccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcag

SEQ ID NO: 4013 - DNA, 108 bp, Homo sapiens
  chr13:37005473-37005581
  hyper
agtcacctatgcaggcgtctgagcccccgggtttccaggagccccccgtataaggaccccagggactcctctccccacgcggccgggccgcccgcccggcccccagcc

SEQ ID NO: 4014 - DNA, 164 bp, Homo sapiens
  chr13:37005899-37006063
  hyper
ggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagc

SEQ ID NO: 4015 - DNA, 192 bp, Homo sapiens
  chr13:37006433-37006625
  hyper
cgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgca

SEQ ID NO: 4016 - DNA, 517 bp, Homo sapiens
  chr13:43566059-43566576
  hyper
agtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctca

SEQ ID NO: 4017 - DNA, 739 bp, Homo sapiens; identical to SEQ ID NO: 1105
  chr13:44947737-44948476
  hyper

SEQ ID NO: 4018 - DNA, 780 bp, Homo sapiens; identical to SEQ ID NO: 1106
  chr13:49794146-49794926
  hyper

SEQ ID NO: 4019 - DNA, 336 bp, Homo sapiens; identical to SEQ ID NO: 1107
  chr13:53312978-53313314
  hyper

SEQ ID NO: 4020 - DNA, 17 bp, Homo sapiens
  chr13:53313512-53313529
  hyper
cgcagcacagggccttc

SEQ ID NO: 4021 - DNA, 83 bp, Homo sapiens; identical to SEQ ID NO: 1109
  chr13:53313530-53313613
  hyper

SEQ ID NO: 4022 - DNA, 37 bp, Homo sapiens; identical to SEQ ID NO: 1110
  chr13:53313677-53313714
  hyper

SEQ ID NO: 4023 - DNA, 592 bp, Homo sapiens; identical to SEQ ID NO: 1111
  chr13:58208334-58208926
  hyper

SEQ ID NO: 4024 - DNA, 152 bp, Homo sapiens
  chr13:70681626-70681778
  hyper
agaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 4025 - DNA, 205 bp, Homo sapiens
  chr13:70681866-70682071
  hyper
cgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccacc

SEQ ID NO: 4026 - DNA, 86 bp, Homo sapiens
  chr13:78493110-78493196
  hyper
agcgtgcgtgggaaccgcggaattaaggcacctagaggccaagggcttgtgtcaagctctgcattttgccccgcaggggaacctct

SEQ ID NO: 4027 - DNA, 37 bp, Homo sapiens; identical to SEQ ID NO: 1112
  chr13:79170347-79170384
  hyper

SEQ ID NO: 4028 - DNA, 372 bp, Homo sapiens; identical to SEQ ID NO: 1113
  chr13:79170467-79170839
  hyper

SEQ ID NO: 4029 - DNA, 242 bp, Homo sapiens; identical to SEQ ID NO: 1114
  chr13:79175702-79175944
  hyper

SEQ ID NO: 4030 - DNA, 49 bp, Homo sapiens; identical to SEQ ID NO: 1115
  chr13:79176077-79176126
  hyper

SEQ ID NO: 4031 - DNA, 145 bp, Homo sapiens; identical to SEQ ID NO: 1116
  chr13:79176276-79176421
  hyper

SEQ ID NO: 4032 - DNA, 224 bp, Homo sapiens; identical to SEQ ID NO: 1117
  chr13:79176608-79176832
  hyper

SEQ ID NO: 4033 - DNA, 104 bp, Homo sapiens; identical to SEQ ID NO: 1118
  chr13:79177081-79177185
  hyper

SEQ ID NO: 4034 - DNA, 318 bp, Homo sapiens; identical to SEQ ID NO: 1119
  chr13:79177305-79177623
  hyper

SEQ ID NO: 4035 - DNA, 175 bp, Homo sapiens; identical to SEQ ID NO: 1120
  chr13:79177885-79178060
  hyper

SEQ ID NO: 4036 - DNA, 346 bp, Homo sapiens
  chr13:88323468-88323814
  hyper
ctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcgga

SEQ ID NO: 4037 - DNA, 173 bp, Homo sapiens
  chr13:96296383-96296556
  hyper
ccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggc

SEQ ID NO: 4038 - DNA, 110 bp, Homo sapiens
  chr13:96296840-96296950
  hyper
cgccgctctagggccttccagactccggaccacggacgactcaggataccccacccccctcccgccccctcccctccgcgatctccctccggcctcttccctcggtgtcc

SEQ ID NO: 4039 - DNA, 229 bp, Homo sapiens
  chr13:96296991-96297220
  hyper
cgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcag

SEQ ID NO: 4040 - DNA, 344 bp, Homo sapiens
  chr13:100608461-100608805
  hyper
ggcacctcctgctcccactcccctctccgcccagccgtgggcagctgaaatggatgtgatttcacgcacttcctgcgcgcgcacacacacatgcacacatggacatacacttgcacacacgcacaacgcgcattccccctccaatgccgcccgcacacgtgcgcgagcctggacgttccccttttgtgctcgttttgcaggcccagagctcctgctgctggttttctcctttctctccttcatcgcctcttccttcgccactttccttctggaccctccgggctggctcctgcccctctgccccggtggcgctctcgcctattcctcccgggaggagccggggc

SEQ ID NO: 4041 - DNA, 103 bp, Homo sapiens
  chr13:100608838-100608941
  hyper
cgagttctgggacggctgggaccaaagggctggcctccggcctgcgccctgtttgttttcctttcgccccctgaatactagattgagacgtaaagattacccg

SEQ ID NO: 4042 - DNA, 150 bp, Homo sapiens
  chr13:100630730-100630880
  hyper
gaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcg

SEQ ID NO: 4043 - DNA, 51 bp, Homo sapiens; identical to SEQ ID NO: 1121
  chr13:100642150-100642201
  hyper

SEQ ID NO: 4044 - DNA, 227 bp, Homo sapiens; identical to SEQ ID NO: 1122
  chr13:100649349-100649576
  hyper

SEQ ID NO: 4045 - DNA, 86 bp, Homo sapiens; identical to SEQ ID NO: 1123
  chr13:100649799-100649885
  hyper

SEQ ID NO: 4046 - DNA, 230 bp, Homo sapiens; identical to SEQ ID NO: 1124
  chr13:102569312-102569542
  hyper

SEQ ID NO: 4047 - DNA, 307 bp, Homo sapiens
  chr13:103052521-103052828
  hyper
acttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 4048 - DNA, 380 bp, Homo sapiens
  chr13:103052829-103053209
  hyper
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctca

SEQ ID NO: 4049 - DNA, 80 bp, Homo sapiens
  chr13:109147783-109147863
  hyper
aggagtggagagaggcgcggtctcctggaacgcgcgggggaacgtggaaaggagggcgcgggagacccggagggctgccc

SEQ ID NO: 4050 - DNA, 115 bp, Homo sapiens
  chr13:109148154-109148269
  hyper
cgggcacaggggcaactgccgacccctctcacccgccgcgcggggctggtttccgagccgagtcccggccatcgccgcgtcgcctggcgcccggctccggcggacccttctccgg

SEQ ID NO: 4051 - DNA, 132 bp, Homo sapiens
  chr13:110959517-110959649
  hyper
cgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgc

SEQ ID NO: 4052 - DNA, 275 bp, Homo sapiens
  chr13:110959752-110960027
  hyper
cgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacc

SEQ ID NO: 4053 - DNA, 176 bp, Homo sapiens
  chr13:112707743-112707919
  hyper
tgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttc

SEQ ID NO: 4054 - DNA, 206 bp, Homo sapiens
  chr13:112708307-112708513
  hyper
cgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacaccc

SEQ ID NO: 4055 - DNA, 125 bp, Homo sapiens
  chr13:112711624-112711749
  hyper
tgtttctctctgggtcgccatttttggggaggggggagggaggtcgagtctgtggatttgggggagaggttcttgtccgccacagctccgcgccccctccccgcccctcgcggctcccccaccct

SEQ ID NO: 4056 - DNA, 930 bp, Homo sapiens; identical to SEQ ID NO: 1125
  chr13:112712048-112712978
  hyper

SEQ ID NO: 4057 - DNA, 260 bp, Homo sapiens; identical to SEQ ID NO: 1126
  chr13:112715354-112715614
  hyper

SEQ ID NO: 4058 - DNA, 417 bp, Homo sapiens; identical to SEQ ID NO: 1127
  chr13:112715936-112716353
  hyper

SEQ ID NO: 4059 - DNA, 509 bp, Homo sapiens
  chr13:112720518-112721027
  hyper
tactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 4060 - DNA, 93 bp, Homo sapiens
  chr13:112722128-112722221
  hyper
cggcccatgaacgccttcatggtgtggtcccgcgggcagcggcgcaagatggcccaggagaaccccaagatgcacaactcggagatcagcaag

SEQ ID NO: 4061 - DNA, 38 bp, Homo sapiens
  chr13:112722274-112722312
  hyper
cgacgaggccaagcggctgcgcgcgctgcacatgaagg

SEQ ID NO: 4062 - DNA, 361 bp, Homo sapiens; identical to SEQ ID NO: 1128
  chr13:112758012-112758373
  hyper

SEQ ID NO: 4063 - DNA, 196 bp, Homo sapiens; identical to SEQ ID NO: 1129
  chr13:112758495-112758691
  hyper

SEQ ID NO: 4064 - DNA, 205 bp, Homo sapiens
  chr13:112759202-112759407
  hyper
gaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcggg

SEQ ID NO: 4065 - DNA, 348 bp, Homo sapiens; identical to SEQ ID NO: 1130
  chr13:112760850-112761198
  hyper

SEQ ID NO: 4066 - DNA, 323 bp, Homo sapiens; identical to SEQ ID NO: 1131
  chr14:24803594-24803917
  hyper

SEQ ID NO: 4067 - DNA, 205 bp, Homo sapiens; identical to SEQ ID NO: 1132
  chr14:24803918-24804123
  hyper

SEQ ID NO: 4068 - DNA, 23 bp, Homo sapiens
  chr14:24804424-24804447
  hyper
cgcctccccgcttcagccccttc

SEQ ID NO: 4069 - DNA, 223 bp, Homo sapiens
  chr14:26674354-26674577
  hyper
ggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 4070 - DNA, 82 bp, Homo sapiens
  chr14:29226033-29226115
  hyper
gagatctcagatcttcgcgtttggggtggggagtgggggcgctggggaaaagtcgggaatagccccgcggtacctggggatc

SEQ ID NO: 4071 - DNA, 356 bp, Homo sapiens
  chr14:29228628-29228984
  hyper
agaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgtta

SEQ ID NO: 4072 - DNA, 439 bp, Homo sapiens; identical to SEQ ID NO: 1134
  chr14:29234853-29235292
  hyper

SEQ ID NO: 4073 - DNA, 15 bp, Homo sapiens
  chr14:29254425-29254440
  hyper
ggcgcccgcagaagc

SEQ ID NO: 4074 - DNA, 32 bp, Homo sapiens
  chr14:29254611-29254643
  hyper
cgcgtccgccgggaccccgtccctctttcccc

SEQ ID NO: 4075 - DNA, 655 bp, Homo sapiens
  chr14:36004080-36004735
  hyper
cgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagatttt

SEQ ID NO: 4076 - DNA, 101 bp, Homo sapiens
  chr14:36004821-36004922
  hyper
cgctagcgccgggctttggctccgaacgcggtgccccacttgccttcgcttgcccattgtgcggagcgcacttccctacagcagatatcagggagaagcac

SEQ ID NO: 4077 - DNA, 84 bp, Homo sapiens; identical to SEQ ID NO: 1135
  chr14:36973454-36973538
  hyper

SEQ ID NO: 4078 - DNA, 230 bp, Homo sapiens
  chr14:36974533-36974763
  hyper
tagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctgg

SEQ ID NO: 4079 - DNA, 427 bp, Homo sapiens
  chr14:36977503-36977930
  hyper
ggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgt

SEQ ID NO: 4080 - DNA, 438 bp, Homo sapiens
  chr14:36983708-36984146
  hyper
gacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagc

SEQ ID NO: 4081 - DNA, 171 bp, Homo sapiens; identical to SEQ ID NO: 1136
  chr14:36986301-36986472
  hyper

SEQ ID NO: 4082 - DNA, 249 bp, Homo sapiens; identical to SEQ ID NO: 1137
  chr14:36987301-36987550
  hyper

SEQ ID NO: 4083 - DNA, 172 bp, Homo sapiens
  chr14:36987960-36988132
  hyper
gtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggc

SEQ ID NO: 4084 - DNA, 175 bp, Homo sapiens; identical to SEQ ID NO: 1138
  chr14:36990858-36991033
  hyper

SEQ ID NO: 4085 - DNA, 92 bp, Homo sapiens; identical to SEQ ID NO: 1139
  chr14:36991094-36991186
  hyper

SEQ ID NO: 4086 - DNA, 178 bp, Homo sapiens; identical to SEQ ID NO: 1140
  chr14:36991600-36991778
  hyper

SEQ ID NO: 4087 - DNA, 37 bp, Homo sapiens; identical to SEQ ID NO: 1141
  chr14:36991988-36992025
  hyper

SEQ ID NO: 4088 - DNA, 141 bp, Homo sapiens
  chr14:36993815-36993956
  hyper
aagcttttctcaattcgtggcctgtgggcaggctggggggtggggcgccaagtcatccgagcgcggcttctgcttctccctttccctcacaggcatgctctacggagggtatgggaggcgagggcgcgtctatgagggcca

SEQ ID NO: 4089 - DNA, 643 bp, Homo sapiens
  chr14:36994366-36995009
  hyper
gggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 4090 - DNA, 40 bp, Homo sapiens
  chr14:36995010-36995050
  hyper
cattcgctcattctaactgtccgcccgaccatacgtcagg

SEQ ID NO: 4091 - DNA, 190 bp, Homo sapiens
  chr14:37116105-37116295
  hyper
ctggagacttggggacgtgaagggggggttctgtgatcccggaaaaaaagtaacttctcttggtaggtgatactaggcagttgcgtcccggggagtccccgcctttctgcgcttcccctgacgggggcacaggggccggcgtgcgtgtgtgggtacgtagctcatcccggggagctgggatcctcttttc

SEQ ID NO: 4092 - DNA, 453 bp, Homo sapiens; identical to SEQ ID NO: 1142
  chr14:37123566-37124019
  hyper

SEQ ID NO: 4093 - DNA, 91 bp, Homo sapiens; identical to SEQ ID NO: 1143
  chr14:37124481-37124572
  hyper

SEQ ID NO: 4094 - DNA, 30 bp, Homo sapiens
  chr14:37124992-37125022
  hyper
gcaagagaatccgcccggtagggcatagaa

SEQ ID NO: 4095 - DNA, 420 bp, Homo sapiens
  chr14:37125232-37125652
  hyper
ggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 4096 - DNA, 173 bp, Homo sapiens
  chr14:37126156-37126329
  hyper
gcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccg

SEQ ID NO: 4097 - DNA, 264 bp, Homo sapiens; identical to SEQ ID NO: 1144
  chr14:37132290-37132554
  hyper

SEQ ID NO: 4098 - DNA, 33 bp, Homo sapiens; identical to SEQ ID NO: 1145
  chr14:37132602-37132635
  hyper

SEQ ID NO: 4099 - DNA, 67 bp, Homo sapiens
  chr14:37136294-37136361
  hyper
gttcggactttctctccggtggctctcggacaaacacgcttggccaatcctgcggagaggggcaccc

SEQ ID NO: 4100 - DNA, 382 bp, Homo sapiens; identical to SEQ ID NO: 1146
  chr14:38724978-38725360
  hyper

SEQ ID NO: 4101 - DNA, 236 bp, Homo sapiens
  chr14:42075538-42075774
  hyper
gttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgc

SEQ ID NO: 4102 - DNA, 164 bp, Homo sapiens
  chr14:42076803-42076967
  hyper
gcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacct

SEQ ID NO: 4103 - DNA, 37 bp, Homo sapiens
  chr14:48144727-48144764
  hyper
tagaggtgctctggccggccgcaccaattcccggagc

SEQ ID NO: 4104 - DNA, 126 bp, Homo sapiens
  chr14:48145236-48145362
  hyper
cgcaggcggaccggcggccgggctgctgggctgctgggctgccggggaggaaggctgtgtgtggtcacgttgtgcgctacgtgctgagagcgcgagctgctagccgcagccgggcgacgtcaaagc

SEQ ID NO: 4105 - DNA, 197 bp, Homo sapiens
  chr14:48145469-48145666
  hyper
cgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttcc

SEQ ID NO: 4106 - DNA, 385 bp, Homo sapiens; identical to SEQ ID NO: 1147
  chr14:51560329-51560714
  hyper

SEQ ID NO: 4107 - DNA, 523 bp, Homo sapiens; identical to SEQ ID NO: 1148
  chr14:51560770-51561293
  hyper

SEQ ID NO: 4108 - DNA, 226 bp, Homo sapiens; identical to SEQ ID NO: 1149
  chr14:51561294-51561520
  hyper

SEQ ID NO: 4109 - DNA, 379 bp, Homo sapiens; identical to SEQ ID NO: 1150
  chr14:52534648-52535027
  hyper

SEQ ID NO: 4110 - DNA, 209 bp, Homo sapiens; identical to SEQ ID NO: 1151
  chr14:52535055-52535264
  hyper

SEQ ID NO: 4111 - DNA, 91 bp, Homo sapiens; identical to SEQ ID NO: 1152
  chr14:52535334-52535425
  hyper

SEQ ID NO: 4112 - DNA, 332 bp, Homo sapiens; identical to SEQ ID NO: 1153
  chr14:52535426-52535758
  hyper

SEQ ID NO: 4113 - DNA, 214 bp, Homo sapiens; identical to SEQ ID NO: 1154
  chr14:52535759-52535973
  hyper

SEQ ID NO: 4114 - DNA, 92 bp, Homo sapiens; identical to SEQ ID NO: 1155
  chr14:52535974-52536066
  hyper

SEQ ID NO: 4115 - DNA, 38 bp, Homo sapiens; identical to SEQ ID NO: 1156
  chr14:52536067-52536105
  hyper

SEQ ID NO: 4116 - DNA, 50 bp, Homo sapiens; identical to SEQ ID NO: 1157
  chr14:52536342-52536392
  hyper

SEQ ID NO: 4117 - DNA, 332 bp, Homo sapiens
  chr14:52781525-52781857
  hyper
cagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctg

SEQ ID NO: 4118 - DNA, 220 bp, Homo sapiens; identical to SEQ ID NO: 1158
  chr14:57260875-57261095
  hyper

SEQ ID NO: 4119 - DNA, 234 bp, Homo sapiens; identical to SEQ ID NO: 1159
  chr14:57261174-57261408
  hyper

SEQ ID NO: 4120 - DNA, 382 bp, Homo sapiens; identical to SEQ ID NO: 1160
  chr14:57261465-57261847
  hyper

SEQ ID NO: 4121 - DNA, 567 bp, Homo sapiens; identical to SEQ ID NO: 1161
  chr14:57264079-57264646
  hyper

SEQ ID NO: 4122 - DNA, 43 bp, Homo sapiens; identical to SEQ ID NO: 1162
  chr14:57264764-57264807
  hyper

SEQ ID NO: 4123 - DNA, 93 bp, Homo sapiens; identical to SEQ ID NO: 1163
  chr14:57265147-57265240
  hyper

SEQ ID NO: 4124 - DNA, 15 bp, Homo sapiens
  chr14:57270957-57270972
  hyper
aagatgtctgggtac

SEQ ID NO: 4125 - DNA, 28 bp, Homo sapiens
  chr14:57271153-57271181
  hyper
cgcagcagtcccccgttcctcacagccc

SEQ ID NO: 4126 - DNA, 58 bp, Homo sapiens
  chr14:57272009-57272067
  hyper
agggtgttgcatccccggagggtgggcatggggaagaggggtgcgggagtgcagcagg

SEQ ID NO: 4127 - DNA, 322 bp, Homo sapiens; identical to SEQ ID NO: 1166
  chr14:57274417-57274739
  hyper

SEQ ID NO: 4128 - DNA, 310 bp, Homo sapiens; identical to SEQ ID NO: 1167
  chr14:57274740-57275050
  hyper

SEQ ID NO: 4129 - DNA, 17 bp, Homo sapiens
  chr14:57275210-57275227
  hyper
cgcgagggagggaggaa

SEQ ID NO: 4130 - DNA, 201 bp, Homo sapiens
  chr14:57275485-57275686
  hyper
agggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcc

SEQ ID NO: 4131 - DNA, 593 bp, Homo sapiens
  chr14:57276073-57276666
  hyper
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctc

SEQ ID NO: 4132 - DNA, 417 bp, Homo sapiens; identical to SEQ ID NO: 1169
  chr14:57277979-57278396
  hyper

SEQ ID NO: 4133 - DNA, 69 bp, Homo sapiens; identical to SEQ ID NO: 1170
  chr14:57278694-57278763
  hyper

SEQ ID NO: 4134 - DNA, 728 bp, Homo sapiens; identical to SEQ ID NO: 1171
  chr14:57278837-57279565
  hyper

SEQ ID NO: 4135 - DNA, 110 bp, Homo sapiens; identical to SEQ ID NO: 1172
  chr14:57283299-57283409
  hyper

SEQ ID NO: 4136 - DNA, 592 bp, Homo sapiens; identical to SEQ ID NO: 1173
  chr14:57283445-57284037
  hyper

SEQ ID NO: 4137 - DNA, 541 bp, Homo sapiens; identical to SEQ ID NO: 1174
  chr14:57284070-57284611
  hyper

SEQ ID NO: 4138 - DNA, 330 bp, Homo sapiens
  chr14:60794473-60794803
  hyper
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggt

SEQ ID NO: 4139 - DNA, 225 bp, Homo sapiens; identical to SEQ ID NO: 1175
  chr14:60952195-60952420
  hyper

SEQ ID NO: 4140 - DNA, 117 bp, Homo sapiens; identical to SEQ ID NO: 1176
  chr14:60952516-60952633
  hyper

SEQ ID NO: 4141 - DNA, 218 bp, Homo sapiens; identical to SEQ ID NO: 1177
  chr14:60952729-60952947
  hyper

SEQ ID NO: 4142 - DNA, 311 bp, Homo sapiens; identical to SEQ ID NO: 1178
  chr14:60973697-60974008
  hyper

SEQ ID NO: 4143 - DNA, 441 bp, Homo sapiens; identical to SEQ ID NO: 1179
  chr14:60975448-60975889
  hyper

SEQ ID NO: 4144 - DNA, 440 bp, Homo sapiens; identical to SEQ ID NO: 1180
  chr14:60976074-60976514
  hyper

SEQ ID NO: 4145 - DNA, 279 bp, Homo sapiens
  chr14:60977434-60977713
  hyper
ccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 4146 - DNA, 285 bp, Homo sapiens
  chr14:60977879-60978164
  hyper
cgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcg

SEQ ID NO: 4147 - DNA, 567 bp, Homo sapiens
  chr14:60981226-60981793
  hyper
ctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaagggg

SEQ ID NO: 4148 - DNA, 258 bp, Homo sapiens; identical to SEQ ID NO: 1181
  chr14:60982110-60982368
  hyper

SEQ ID NO: 4149 - DNA, 316 bp, Homo sapiens; identical to SEQ ID NO: 1182
  chr14:61104241-61104557
  hyper

SEQ ID NO: 4150 - DNA, 241 bp, Homo sapiens; identical to SEQ ID NO: 1183
  chr14:61104623-61104864
  hyper

SEQ ID NO: 4151 - DNA, 154 bp, Homo sapiens
  chr14:62279322-62279476
  hyper
cggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcc

SEQ ID NO: 4152 - DNA, 104 bp, Homo sapiens
  chr14:62279519-62279623
  hyper
cgactgacagtgagtgcgctccggccgcggaggccaggggtggggggaggccgcggtgcccagggtgggaagttcgatttcagacgctgcctttgtgctggctc

SEQ ID NO: 4153 - DNA, 229 bp, Homo sapiens
  chr14:62279624-62279853
  hyper
cggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaa

SEQ ID NO: 4154 - DNA, 15 bp, Homo sapiens
  chr14:62279898-62279913
  hyper
cgagttctgggtcgg

SEQ ID NO: 4155 - DNA, 124 bp, Homo sapiens
  chr14:63511883-63512007
  hyper
ccctctcttgccccccggcatcctgggtctggagagcagcggccaggatccgcggcgggggagggggggatgcaggcaaagaaggtggaggaagaggaggaaaaggtggaagagaagattgagc

SEQ ID NO: 4156 - DNA, 646 bp, Homo sapiens
  chr14:63512063-63512709
  hyper
cgacccggatgagcagctctggggaggaggaccaggcagttcatggtagtagcgctcccccggccgccgctgcccagactgtggcggtgccgcacacggggctcgggaactgcaggctccgcggggcacagtgcgcctgcgccgcccccgctgtcgctgtcccgccggtgctgatgctgaggctgctgctgaggctgctaccgcggcggccggcgcctgggcgcgggctctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcggaggctcacatctcggcgtctcccgctcgggtcccgaatccgggctgctggcgcggacgcggctcccggggcggaggtgcgggcaggctccagctccagccccagccgaggctgagagcagggcagggactggctggg

SEQ ID NO: 4157 - DNA, 81 bp, Homo sapiens
  chr14:63512740-63512821
  hyper
cgctgctaccgcccccctccgggctccggcgcctgaaaccttcctgaacactggcgctttccgcaccgcccttaccccacc

SEQ ID NO: 4158 - DNA, 73 bp, Homo sapiens
  chr14:63513035-63513108
  hyper
tgaataattcacacccgagagagggggagtgaggagggcagtgttagcgatggaaaaacggtaaaggctgtgg

SEQ ID NO: 4159 - DNA, 246 bp, Homo sapiens
  chr14:70014699-70014945
  hyper
acagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccct

SEQ ID NO: 4160 - DNA, 220 bp, Homo sapiens; identical to SEQ ID NO: 1184
  chr14:70654070-70654290
  hyper

SEQ ID NO: 4161 - DNA, 306 bp, Homo sapiens; identical to SEQ ID NO: 1185
  chr14:70654291-70654597
  hyper

SEQ ID NO: 4162 - DNA, 41 bp, Homo sapiens; identical to SEQ ID NO: 1186
  chr14:70654598-70654639
  hyper

SEQ ID NO: 4163 - DNA, 147 bp, Homo sapiens; identical to SEQ ID NO: 1187
  chr14:70654640-70654787
  hyper

SEQ ID NO: 4164 - DNA, 858 bp, Homo sapiens
  chr14:70655032-70655890
  hyper
ctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcc

SEQ ID NO: 4165 - DNA, 171 bp, Homo sapiens
  chr14:70655919-70656090
  hyper
cgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgt

SEQ ID NO: 4166 - DNA, 547 bp, Homo sapiens
  chr14:72398686-72399233
  hyper
ttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 4167 - DNA, 2 bp, Homo sapiens
  chr14:72399451-72399453
  hyper
cg

SEQ ID NO: 4168 - DNA, 88 bp, Homo sapiens
  chr14:72399929-72400017
  hyper
tttctgggtgtgaagcgcacaccgacggggacgagagcgcagaggatggcgcttttagatacttccagtcttccgatgttgtgatcgc

SEQ ID NO: 4169 - DNA, 351 bp, Homo sapiens; identical to SEQ ID NO: 1188
  chr14:74706046-74706397
  hyper

SEQ ID NO: 4170 - DNA, 605 bp, Homo sapiens; identical to SEQ ID NO: 1189
  chr14:74706940-74707545
  hyper

SEQ ID NO: 4171 - DNA, 176 bp, Homo sapiens; identical to SEQ ID NO: 1190
  chr14:74707572-74707748
  hyper

SEQ ID NO: 4172 - DNA, 120 bp, Homo sapiens; identical to SEQ ID NO: 1191
  chr14:74707791-74707911
  hyper

SEQ ID NO: 4173 - DNA, 418 bp, Homo sapiens; identical to SEQ ID NO: 1192
  chr14:74707912-74708330
  hyper

SEQ ID NO: 4174 - DNA, 174 bp, Homo sapiens
  chr14:74708862-74709036
  hyper
ctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttc

SEQ ID NO: 4175 - DNA, 70 bp, Homo sapiens; identical to SEQ ID NO: 1193
  chr14:89817946-89818016
  hyper

SEQ ID NO: 4176 - DNA, 487 bp, Homo sapiens
  chr14:90084100-90084587
  hyper
aacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaatt

SEQ ID NO: 4177 - DNA, 358 bp, Homo sapiens
  chr14:95235025-95235383
  hyper
cgcgcttcccccagtcccggggcacccggggagcttggtgtggcggcgggacaccccgcgcaggccaacaaaaggaggggagccgctcgctcccgcttccgcgttttcattcaacttcctgggcctaaagcgccctccagcagcctgcgggccgccatcgggatgtttttaaagtgcggggagagccaagcagggctgggcaaacccgactggggccccacctcgcggggaaggaccgctaggcgcccacggcaggccccggcgcctacctccactttctcctcgcggaggtgcactttccgggccagctgctcgcgcgtgcccacgtccgggtacttggtctcctggaagaggttct

SEQ ID NO: 4178 - DNA, 212 bp, Homo sapiens; identical to SEQ ID NO: 1194
  chr14:95239421-95239633
  hyper

SEQ ID NO: 4179 - DNA, 132 bp, Homo sapiens
  chr14:96342892-96343024
  hyper
ttgcggccgggtgggcgccccgccgctgcggtcgcggtcgccgctggtaagctgcgctctggggcttggggcaggaagcagtggggggcgctcgaagagcagggcagctacggccaccgtggccgccggacc

SEQ ID NO: 4180 - DNA, 131 bp, Homo sapiens
  chr14:97685497-97685628
  hyper
taattggagaagattcggttttcttcgccatggcaggtccctttctcctgacccgcagttgcaggggctgagggtaggcgcaggtccgccctggggtcgaagccaccatcgggcctcgaggttgcccccct

SEQ ID NO: 4181 - DNA, 61 bp, Homo sapiens
  chr14:97685882-97685943
  hyper
acgcggcggtctgggcgctgcaggatgcgcctggccgcggaggagacgaccagggagcggg

SEQ ID NO: 4182 - DNA, 171 bp, Homo sapiens
  chr14:101543828-101543999
  hyper
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgg

SEQ ID NO: 4183 - DNA, 27 bp, Homo sapiens
  chr14:101924030-101924057
  hyper
gacgccctggcccggtgtccccgacgc

SEQ ID NO: 4184 - DNA, 746 bp, Homo sapiens
  chr14:103021342-103022088
  hyper
cgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagc

SEQ ID NO: 4185 - DNA, 201 bp, Homo sapiens
  chr14:103739949-103740150
  hyper
ctccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagct

SEQ ID NO: 4186 - DNA, 190 bp, Homo sapiens
  chr15:23158337-23158527
  hyper
cgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctc

SEQ ID NO: 4187 - DNA, 104 bp, Homo sapiens
  chr15:26107640-26107744
  hyper
gtcggcaccgggtcccgcgcagccgggccctccaccctgagtggagctgccttctaagcacccagcccctgccaatcactgtgcccaacaccaagttcccgggg

SEQ ID NO: 4188 - DNA, 482 bp, Homo sapiens
  chr15:26107845-26108327
  hyper
cggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccggg

SEQ ID NO: 4189 - DNA, 261 bp, Homo sapiens; identical to SEQ ID NO: 1195
  chr15:28341719-28341980
  hyper

SEQ ID NO: 4190 - DNA, 39 bp, Homo sapiens; identical to SEQ ID NO: 1196
  chr15:28341981-28342020
  hyper

SEQ ID NO: 4191 - DNA, 15 bp, Homo sapiens
  chr15:28342521-28342536
  hyper
cggccccaaggagct

SEQ ID NO: 4192 - DNA, 77 bp, Homo sapiens
  chr15:28352021-28352098
  hyper
cctgtcctggtgccccgggcttccacccggcgggctggcgtgcgggggctggtcttcgccgagatcctgctgggagc

SEQ ID NO: 4193 - DNA, 22 bp, Homo sapiens
  chr15:28352099-28352121
  hyper
ggctctggccccacggtgagcc

SEQ ID NO: 4194 - DNA, 270 bp, Homo sapiens
  chr15:28352152-28352422
  hyper
cgcgcggggagggagagtccggcagggtcacgaggcgccggccccggggccgcttgaaacccgaagagaccccgctcgctcgcgcgcccgccggacgaatcctcgcggaggtcccggggcgcagccggcgtgagggtggggtctcatcgcaggggcgccgggagcctccccgctccgctagctcaaccaaggaccgctcagaggggctctcaccctgaacctcggcttttctaaaggaagggcagaccccagatttcccccttctcttct

SEQ ID NO: 4195 - DNA, 148 bp, Homo sapiens
  chr15:29077246-29077394
  hyper
acttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaag

SEQ ID NO: 4196 - DNA, 170 bp, Homo sapiens
  chr15:29077428-29077598
  hyper
cgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgt

SEQ ID NO: 4197 - DNA, 291 bp, Homo sapiens
  chr15:29130757-29131048
  hyper
caaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 4198 - DNA, 99 bp, Homo sapiens
  chr15:29131532-29131631
  hyper
cgagcgctccagagcgctgccctcccgactcagcgtggctgcggggcggccgccgctgggatatgggggtacagcccggcggccccactcctctctgac

SEQ ID NO: 4199 - DNA, 152 bp, Homo sapiens
  chr15:29131755-29131907
  hyper
cggggctgtccgctcgactcctgccgggctggccgggctgcttggcaccggcatcaagtccccgtgccgggcggcaactactgagtttggggtcgcctctgggttcgctgcccccagagaacccaagcccagatcttcgcccccttcccttt

SEQ ID NO: 4200 - DNA, 6 bp, Homo sapiens
  chr15:31775468-31775474
  hyper
cctcgc

SEQ ID NO: 4201 - DNA, 155 bp, Homo sapiens
  chr15:31775483-31775638
  hyper
cgcgccgcgccgctcagggccgggccccgcgcgcctcgcgccgccgccgcagctcctcgcggtagcagtaggagcagtagtgctcggtctcggcgcgcccgtagaacgcacagttctcgcgctggcagcgccgctgcaccggccccgggccgcca

SEQ ID NO: 4202 - DNA, 105 bp, Homo sapiens
  chr15:31775678-31775783
  hyper
cgtcggcgaactccaggccgtcgcgcagggcgccgaagccgttggtgtaggtctgcgacttgtgctcggccgcccccgccgtccccgccgcgcccggtagggccc

SEQ ID NO: 4203 - DNA, 316 bp, Homo sapiens
  chr15:33010850-33011166
  hyper
gcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccacc

SEQ ID NO: 4204 - DNA, 181 bp, Homo sapiens
  chr15:33011167-33011348
  hyper
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccac

SEQ ID NO: 4205 - DNA, 491 bp, Homo sapiens
  chr15:33603118-33603609
  hyper
ggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 4206 - DNA, 114 bp, Homo sapiens
  chr15:33603647-33603761
  hyper
cgttggaagccctcgccccggggtcggccctctgacacctccatactccaccccagccccattcctcttccagggcgcccccacgcacaggggaacctccgggaaggagccagc

SEQ ID NO: 4207 - DNA, 334 bp, Homo sapiens; identical to SEQ ID NO: 1198
  chr15:34786610-34786944
  hyper

SEQ ID NO: 4208 - DNA, 103 bp, Homo sapiens; identical to SEQ ID NO: 1199
  chr15:34787232-34787335
  hyper

SEQ ID NO: 4209 - DNA, 291 bp, Homo sapiens; identical to SEQ ID NO: 1200
  chr15:37180507-37180798
  hyper

SEQ ID NO: 4210 - DNA, 454 bp, Homo sapiens
  chr15:40211790-40212244
  hyper
gaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 4211 - DNA, 544 bp, Homo sapiens
  chr15:41805028-41805572
  hyper
gccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggt

SEQ ID NO: 4212 - DNA, 76 bp, Homo sapiens; identical to SEQ ID NO: 1201
  chr15:45403605-45403681
  hyper

SEQ ID NO: 4213 - DNA, 202 bp, Homo sapiens; identical to SEQ ID NO: 1202
  chr15:45403798-45404000
  hyper

SEQ ID NO: 4214 - DNA, 71 bp, Homo sapiens; identical to SEQ ID NO: 1203
  chr15:45479446-45479517
  hyper

SEQ ID NO: 4215 - DNA, 3 bp, Homo sapiens
  chr15:45479774-45479777
  hyper
ggg

SEQ ID NO: 4216 - DNA, 438 bp, Homo sapiens; identical to SEQ ID NO: 1205
  chr15:48936775-48937213
  hyper

SEQ ID NO: 4217 - DNA, 432 bp, Homo sapiens; identical to SEQ ID NO: 1206
  chr15:48937214-48937646
  hyper

SEQ ID NO: 4218 - DNA, 638 bp, Homo sapiens; identical to SEQ ID NO: 1207
  chr15:48937709-48938347
  hyper

SEQ ID NO: 4219 - DNA, 162 bp, Homo sapiens; identical to SEQ ID NO: 1208
  chr15:48938348-48938510
  hyper

SEQ ID NO: 4220 - DNA, 342 bp, Homo sapiens
  chr15:51385864-51386206
  hyper
cgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagc

SEQ ID NO: 4221 - DNA, 15 bp, Homo sapiens
  chr15:53075850-53075865
  hyper
acaaaacaaaggaac

SEQ ID NO: 4222 - DNA, 1016 bp, Homo sapiens; identical to SEQ ID NO: 1210
  chr15:53075985-53077001
  hyper

SEQ ID NO: 4223 - DNA, 461 bp, Homo sapiens; identical to SEQ ID NO: 1211
  chr15:53077065-53077526
  hyper

SEQ ID NO: 4224 - DNA, 414 bp, Homo sapiens
  chr15:53079264-53079678
  hyper
ggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccc

SEQ ID NO: 4225 - DNA, 175 bp, Homo sapiens
  chr15:53079717-53079892
  hyper
cgaattaatggagaacgatcagttaattaacaaaccctcattccggcttttaccttttctcttcgccaaggctcaggcctgggcgctgggctgagatggaggtggaggtggggggtgggggagtggggggggagggggcatggaccaggagtcaatcaacttggcaaccgccggc

SEQ ID NO: 4226 - DNA, 84 bp, Homo sapiens
  chr15:53079970-53080054
  hyper
cgaatcctcctgaaatccccggtggggttcgggctgggctcagctttcttctctgcctatccgcggtctcggggagccaggcgc

SEQ ID NO: 4227 - DNA, 205 bp, Homo sapiens
  chr15:53080337-53080542
  hyper
acagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcg

SEQ ID NO: 4228 - DNA, 56 bp, Homo sapiens
  chr15:53080935-53080991
  hyper
gtaccttatctcccgcgcgcccagctccttggccggctcacctgctaagcggagcg

SEQ ID NO: 4229 - DNA, 243 bp, Homo sapiens
  chr15:53081054-53081297
  hyper
cggatttgagtttgctccagggtttggggttgcgcagcaggtccgagagggtcccctgggagcggcagagcaccctctgcgcgaagatggcctgtgggatgctgtagcgcttgagctcggtggtgatacgctgcgccacctctttggtattgatctcttccatctgccctgaattacttccattgctgacctgcgcgccggtcaccgaagggttgggctcccgggctgtgcccaggagttgcc

SEQ ID NO: 4230 - DNA, 293 bp, Homo sapiens
  chr15:53081398-53081691
  hyper
cggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtg

SEQ ID NO: 4231 - DNA, 15 bp, Homo sapiens
  chr15:53097554-53097569
  hyper
tttttttcgctttgc

SEQ ID NO: 4232 - DNA, 59 bp, Homo sapiens
  chr15:53097777-53097836
  hyper
gggggccttttggggcgccttttaccccagagctcagaaagctccgggcagcggggtgg

SEQ ID NO: 4233 - DNA, 274 bp, Homo sapiens
  chr15:53098416-53098690
  hyper
gccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 4234 - DNA, 548 bp, Homo sapiens; identical to SEQ ID NO: 1212
  chr15:60287038-60287586
  hyper

SEQ ID NO: 4235 - DNA, 33 bp, Homo sapiens; identical to SEQ ID NO: 1213
  chr15:60287643-60287676
  hyper

SEQ ID NO: 4236 - DNA, 189 bp, Homo sapiens
  chr15:60289310-60289499
  hyper
tcagccaacagcccccgcgctgctagagcgcccaaagcagaggccggccgcgaggagggccagagtgcaccgcgggggggtttgcaccgcgctggggttggcaccgcgcgctaggacccacgaagcggcgcgctagtcccaggtgagcacgaaatgagcggaaggactctgccgcggaggggcggcgag

SEQ ID NO: 4237 - DNA, 266 bp, Homo sapiens; identical to SEQ ID NO: 1214
  chr15:60295917-60296183
  hyper

SEQ ID NO: 4238 - DNA, 18 bp, Homo sapiens
  chr15:60296600-60296618
  hyper
cgctgccaccatccgcgc

SEQ ID NO: 4239 - DNA, 256 bp, Homo sapiens; identical to SEQ ID NO: 1216
  chr15:60297153-60297409
  hyper

SEQ ID NO: 4240 - DNA, 153 bp, Homo sapiens
  chr15:60297674-60297827
  hyper
catcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgc

SEQ ID NO: 4241 - DNA, 228 bp, Homo sapiens
  chr15:60297941-60298169
  hyper
cgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttc

SEQ ID NO: 4242 - DNA, 939 bp, Homo sapiens
  chr15:68115594-68116533
  hyper
cggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggaca

SEQ ID NO: 4243 - DNA, 326 bp, Homo sapiens
  chr15:68117665-68117991
  hyper
cttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttca

SEQ ID NO: 4244 - DNA, 809 bp, Homo sapiens; identical to SEQ ID NO: 1217
  chr15:68121149-68121958
  hyper

SEQ ID NO: 4245 - DNA, 488 bp, Homo sapiens; identical to SEQ ID NO: 1218
  chr15:68125223-68125711
  hyper

SEQ ID NO: 4246 - DNA, 647 bp, Homo sapiens
  chr15:68127766-68128413
  hyper
ggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttg

SEQ ID NO: 4247 - DNA, 254 bp, Homo sapiens
  chr15:74658143-74658397
  hyper
tggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 4248 - DNA, 52 bp, Homo sapiens
  chr15:74658501-74658553
  hyper
cgcggcccgggcggcggcgtgcgctgggaggaatgctgggtctgtcgctagc

SEQ ID NO: 4249 - DNA, 91 bp, Homo sapiens
  chr15:74658554-74658645
  hyper
ccaaacttgaccacgctgcgaccttttcactctgtgctctgaccttcaaatctccctcccccgattttttttttttttttttttttgagac

SEQ ID NO: 4250 - DNA, 29 bp, Homo sapiens
  chr15:76627508-76627537
  hyper
tcctaaaggtggaggcggagctcaaaagc

SEQ ID NO: 4251 - DNA, 251 bp, Homo sapiens; identical to SEQ ID NO: 1220
  chr15:76627575-76627826
  hyper

SEQ ID NO: 4252 - DNA, 462 bp, Homo sapiens
  chr15:76628564-76629026
  hyper
ccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagctt

SEQ ID NO: 4253 - DNA, 58 bp, Homo sapiens
  chr15:76629162-76629220
  hyper
gggcgcgcgaccctcgtccttctgcccctggccgcacactttgcgcacatctcttttt

SEQ ID NO: 4254 - DNA, 281 bp, Homo sapiens; identical to SEQ ID NO: 1221
  chr15:76629814-76630095
  hyper

SEQ ID NO: 4255 - DNA, 29 bp, Homo sapiens
  chr15:76630096-76630125
  hyper
gccccgcgcccttccccggcagagaagcc

SEQ ID NO: 4256 - DNA, 244 bp, Homo sapiens; identical to SEQ ID NO: 1223
  chr15:76630519-76630763
  hyper

SEQ ID NO: 4257 - DNA, 91 bp, Homo sapiens
  chr15:78912281-78912372
  hyper
cctcggcaccgagggcggaaagcgctctgagctcacagccgcacgacagaccgccggcctgggccctccaggaattccctgcagccttgcc

SEQ ID NO: 4258 - DNA, 212 bp, Homo sapiens
  chr15:78912441-78912653
  hyper
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggagg

SEQ ID NO: 4259 - DNA, 900 bp, Homo sapiens; identical to SEQ ID NO: 1224
  chr15:79382098-79382998
  hyper

SEQ ID NO: 4260 - DNA, 258 bp, Homo sapiens; identical to SEQ ID NO: 1225
  chr15:79382999-79383257
  hyper

SEQ ID NO: 4261 - DNA, 67 bp, Homo sapiens; identical to SEQ ID NO: 1226
  chr15:79383317-79383384
  hyper

SEQ ID NO: 4262 - DNA, 81 bp, Homo sapiens; identical to SEQ ID NO: 1227
  chr15:79383438-79383519
  hyper

SEQ ID NO: 4263 - DNA, 210 bp, Homo sapiens
  chr15:79724351-79724561
  hyper
cgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcc

SEQ ID NO: 4264 - DNA, 187 bp, Homo sapiens
  chr15:79724606-79724793
  hyper
cggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggagg

SEQ ID NO: 4265 - DNA, 163 bp, Homo sapiens
  chr15:79724863-79725026
  hyper
cgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcg

SEQ ID NO: 4266 - DNA, 75 bp, Homo sapiens
  chr15:79725422-79725497
  hyper
acctgtcagaaagcacgggagctgggcctggcccgcggggagcgtaagctcgctcacacgcggtccaactcaggc

SEQ ID NO: 4267 - DNA, 180 bp, Homo sapiens
  chr15:82340007-82340187
  hyper
tgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttga

SEQ ID NO: 4268 - DNA, 409 bp, Homo sapiens
  chr15:83316231-83316640
  hyper
cgtgcgacggcagtgtgagaaagaaacgttccgggcgccggtgctcctttatgtccggtcagctcccgtctggacagacgctcgaggccgcctggaggccgcagtgcggctcggaggccccaccggccgcccccgcagggctgcggcgcctttaagcccaaaggccctgagtcacgaggaggctccctgcccccctcgccctccacccctccacgaggccccacgcccgcgggcacgtgaccgcgccccgcccgggactcgcccgcacggggcgggggatgggggtaccgcggcgccggacccggctgcgcgcggaccgttagctactgcggccgggacgcggccccgcccaggcgagcggcgggtggctcttaccagcgggaacgccatggggccggtgtggccctgc

SEQ ID NO: 4269 - DNA, 333 bp, Homo sapiens
  chr15:83316641-83316974
  hyper
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaa

SEQ ID NO: 4270 - DNA, 542 bp, Homo sapiens
  chr15:83349070-83349612
  hyper
gggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactg

SEQ ID NO: 4271 - DNA, 38 bp, Homo sapiens
  chr15:83349671-83349709
  hyper
cgatcagcaggttacagagtttccggtagtttttgtga

SEQ ID NO: 4272 - DNA, 69 bp, Homo sapiens
  chr15:83775933-83776002
  hyper
gggctcccccatagacgatcccgcgggcccttcctcctctgacaccctcggatctggttccacctttcc

SEQ ID NO: 4273 - DNA, 116 bp, Homo sapiens
  chr15:83776022-83776138
  hyper
cgcctctccagctcttcgatgaccggttcccggccgtgccccgggccctccctcggagcgcgcgccgccaggggcacctgtccctgcgcgggggtgtcgccgcccctcggcgccgc

SEQ ID NO: 4274 - DNA, 112 bp, Homo sapiens
  chr15:83776157-83776269
  hyper
cgtggcgcccctggcaggagcactgcaaggacgcctcccgggactgcaccgcggccctgcgcacttggggcgacggggccaggcgcgggggacggctgcgggctgggagggc

SEQ ID NO: 4275 - DNA, 37 bp, Homo sapiens
  chr15:83776270-83776307
  hyper
cgcggaggagacaccgctgaggggacgccgctgaggg

SEQ ID NO: 4276 - DNA, 385 bp, Homo sapiens
  chr15:83776332-83776717
  hyper
cgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagaggttcgtggccgcaggggctccccgcgcctggccagactaggggggcgccccaggggtcgcacgggccgggtcttggagc

SEQ ID NO: 4277 - DNA, 64 bp, Homo sapiens; identical to SEQ ID NO: 1228
  chr15:84115747-84115811
  hyper

SEQ ID NO: 4278 - DNA, 42 bp, Homo sapiens; identical to SEQ ID NO: 1229
  chr15:84115812-84115854
  hyper

SEQ ID NO: 4279 - DNA, 194 bp, Homo sapiens; identical to SEQ ID NO: 1230
  chr15:84115931-84116125
  hyper

SEQ ID NO: 4280 - DNA, 42 bp, Homo sapiens; identical to SEQ ID NO: 1231
  chr15:84748578-84748620
  hyper

SEQ ID NO: 4281 - DNA, 691 bp, Homo sapiens; identical to SEQ ID NO: 1232
  chr15:84748678-84749369
  hyper

SEQ ID NO: 4282 - DNA, 492 bp, Homo sapiens; identical to SEQ ID NO: 1233
  chr15:88799507-88799999
  hyper

SEQ ID NO: 4283 - DNA, 302 bp, Homo sapiens; identical to SEQ ID NO: 1234
  chr15:88800000-88800302
  hyper

SEQ ID NO: 4284 - DNA, 555 bp, Homo sapiens; identical to SEQ ID NO: 1235
  chr15:88800412-88800967
  hyper

SEQ ID NO: 4285 - DNA, 213 bp, Homo sapiens
  chr15:89149139-89149352
  hyper
gcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaagggg

SEQ ID NO: 4286 - DNA, 289 bp, Homo sapiens; identical to SEQ ID NO: 1236
  chr15:89346038-89346327
  hyper

SEQ ID NO: 4287 - DNA, 115 bp, Homo sapiens; identical to SEQ ID NO: 1237
  chr15:89346346-89346461
  hyper

SEQ ID NO: 4288 - DNA, 383 bp, Homo sapiens; identical to SEQ ID NO: 1238
  chr15:89903431-89903814
  hyper

SEQ ID NO: 4289 - DNA, 248 bp, Homo sapiens; identical to SEQ ID NO: 1239
  chr15:89922499-89922747
  hyper

SEQ ID NO: 4290 - DNA, 326 bp, Homo sapiens; identical to SEQ ID NO: 1240
  chr15:89949616-89949942
  hyper

SEQ ID NO: 4291 - DNA, 126 bp, Homo sapiens; identical to SEQ ID NO: 1241
  chr15:89950355-89950481
  hyper

SEQ ID NO: 4292 - DNA, 15 bp, Homo sapiens
  chr15:89950722-89950737
  hyper
agttagttacttagc

SEQ ID NO: 4293 - DNA, 208 bp, Homo sapiens
  chr15:89951081-89951289
  hyper
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacaca

SEQ ID NO: 4294 - DNA, 28 bp, Homo sapiens
  chr15:89951349-89951377
  hyper
gataaactcgcttttcttccggtaagtg

SEQ ID NO: 4295 - DNA, 90 bp, Homo sapiens
  chr15:89951465-89951555
  hyper
cggaatgcagggccttaggaaagccctgtccggcgttccagccacaggggtcacacttgcatcaacatgcgggcacgctgccccttgggt

SEQ ID NO: 4296 - DNA, 308 bp, Homo sapiens; identical to SEQ ID NO: 1242
  chr15:89952145-89952453
  hyper

SEQ ID NO: 4297 - DNA, 375 bp, Homo sapiens; identical to SEQ ID NO: 1243
  chr15:89952699-89953074
  hyper

SEQ ID NO: 4298 - DNA, 35 bp, Homo sapiens
  chr15:92937700-92937735
  hyper
ggggtcgagggagggcgccggggagtgtctcgggc

SEQ ID NO: 4299 - DNA, 293 bp, Homo sapiens
  chr15:92937736-92938029
  hyper
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggct

SEQ ID NO: 4300 - DNA, 439 bp, Homo sapiens
  chr15:93632291-93632730
  hyper
ggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgc

SEQ ID NO: 4301 - DNA, 87 bp, Homo sapiens
  chr15:93632731-93632818
  hyper
ggcggcaagtgcggcgactccccggggcgcctccaactttccgaatcgcccgcagggttgcggtggagcgcacggtgtccttcagtt

SEQ ID NO: 4302 - DNA, 221 bp, Homo sapiens
  chr15:93633045-93633266
  hyper
tcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 4303 - DNA, 149 bp, Homo sapiens
  chr15:100913447-100913596
  hyper
ctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtg

SEQ ID NO: 4304 - DNA, 214 bp, Homo sapiens
  chr16:215659-215873
  hyper
agggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 4305 - DNA, 48 bp, Homo sapiens
  chr16:215912-215960
  hyper
cgataaggacgggcggggtgcccggaggctctataaggaggccagggc

SEQ ID NO: 4306 - DNA, 263 bp, Homo sapiens
  chr16:215961-216224
  hyper
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagcccc

SEQ ID NO: 4307 - DNA, 114 bp, Homo sapiens; identical to SEQ ID NO: 1244
  chr16:2040847-2040961
  hyper

SEQ ID NO: 4308 - DNA, 1 bp, Homo sapiens
  chr16:2040980-2040981
  hyper
c

SEQ ID NO: 4309 - DNA, 531 bp, Homo sapiens; identical to SEQ ID NO: 1246
  chr16:2040982-2041513
  hyper

SEQ ID NO: 4310 - DNA, 619 bp, Homo sapiens; identical to SEQ ID NO: 1247
  chr16:2041581-2042200
  hyper

SEQ ID NO: 4311 - DNA, 275 bp, Homo sapiens
  chr16:3017156-3017431
  hyper
cgctgcgcctgggcactgccgcgctgctgctcaccttccgaagcgacgcgcgcggccacgcgcaaggcttcgcgctcacctaccgcggtgagcctcagctcggcgcgccctgcccgctgttcccaccccgctctccccaccccgcctcacgcccctctccgcagggctgcaggacgccgctgaggacccagaggcccccgagggctcggcccagacccccgcggcgcccctcgacggggccaacgtgagctgcagccccaggcctggggctccgc

SEQ ID NO: 4312 - DNA, 40 bp, Homo sapiens
  chr16:3220590-3220630
  hyper
cggagactgagttggctgcggccaccgggtccccggacac

SEQ ID NO: 4313 - DNA, 560 bp, Homo sapiens; identical to SEQ ID NO: 1248
  chr16:3221141-3221701
  hyper

SEQ ID NO: 4314 - DNA, 267 bp, Homo sapiens; identical to SEQ ID NO: 1249
  chr16:3221786-3222053
  hyper

SEQ ID NO: 4315 - DNA, 15 bp, Homo sapiens
  chr16:3222113-3222128
  hyper
cgagccctagaagtg

SEQ ID NO: 4316 - DNA, 376 bp, Homo sapiens; identical to SEQ ID NO: 1251
  chr16:3232641-3233017
  hyper

SEQ ID NO: 4317 - DNA, 133 bp, Homo sapiens; identical to SEQ ID NO: 1252
  chr16:3233198-3233331
  hyper

SEQ ID NO: 4318 - DNA, 670 bp, Homo sapiens; identical to SEQ ID NO: 1253
  chr16:3233434-3234104
  hyper

SEQ ID NO: 4319 - DNA, 196 bp, Homo sapiens; identical to SEQ ID NO: 1254
  chr16:3234164-3234360
  hyper

SEQ ID NO: 4320 - DNA, 164 bp, Homo sapiens; identical to SEQ ID NO: 1255
  chr16:3237900-3238064
  hyper

SEQ ID NO: 4321 - DNA, 1500 bp, Homo sapiens; identical to SEQ ID NO: 1256
  chr16:3238124-3239624
  hyper

SEQ ID NO: 4322 - DNA, 164 bp, Homo sapiens; identical to SEQ ID NO: 1257
  chr16:3239684-3239848
  hyper

SEQ ID NO: 4323 - DNA, 202 bp, Homo sapiens
  chr16:10276597-10276799
  hyper
cccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatcccc

SEQ ID NO: 4324 - DNA, 251 bp, Homo sapiens
  chr16:10276800-10277051
  hyper
cggtccccggccgagagaggcgcgggcggggaaaggcagctccctccgggcccttcgctgctgggccagctccgcgccgggcgttcggctccccacttcccagcgggagtccggtgagcgcctggacaccctggttcacagcactggcaaagccgggttcccggggcgtctttctgctgcggtcgcctccgaggaagaggagaaggaaggtagcggcgccctccacaccaacttagggacttgttctcagc

SEQ ID NO: 4325 - DNA, 328 bp, Homo sapiens
  chr16:10277071-10277399
  hyper
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagtta

SEQ ID NO: 4326 - DNA, 287 bp, Homo sapiens
  chr16:12994459-12994746
  hyper
gaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctggggga

SEQ ID NO: 4327 - DNA, 143 bp, Homo sapiens; identical to SEQ ID NO: 1258
  chr16:22825327-22825470
  hyper

SEQ ID NO: 4328 - DNA, 88 bp, Homo sapiens
  chr16:22825937-22826025
  hyper
tatagggtcctgggccgcgcggggccacctcagccgcggagggcgcgcaggctgctcttcgccttcacgctctcgctctcctgcactt

SEQ ID NO: 4329 - DNA, 216 bp, Homo sapiens; identical to SEQ ID NO: 1259
  chr16:23846838-23847054
  hyper

SEQ ID NO: 4330 - DNA, 15 bp, Homo sapiens
  chr16:23847310-23847325
  hyper
cggcagcagctgggc

SEQ ID NO: 4331 - DNA, 186 bp, Homo sapiens; identical to SEQ ID NO: 1261
  chr16:23847326-23847512
  hyper

SEQ ID NO: 4332 - DNA, 28 bp, Homo sapiens
  chr16:23847788-23847816
  hyper
ggactcccggctccggaccctgctgccc

SEQ ID NO: 4333 - DNA, 58 bp, Homo sapiens; identical to SEQ ID NO: 1263
  chr16:23847817-23847875
  hyper

SEQ ID NO: 4334 - DNA, 70 bp, Homo sapiens; identical to SEQ ID NO: 1264
  chr16:23847933-23848003
  hyper

SEQ ID NO: 4335 - DNA, 68 bp, Homo sapiens; identical to SEQ ID NO: 1265
  chr16:23848004-23848072
  hyper

SEQ ID NO: 4336 - DNA, 120 bp, Homo sapiens
  chr16:24267025-24267145
  hyper
aggattgaagaatgccgcgttgggtgggtgctgagggagcgccagagtgcgctacgggcttcgctccccttcccctttccttaacccttcctagagcggaggaaccgggtcgtgctgcag

SEQ ID NO: 4337 - DNA, 388 bp, Homo sapiens
  chr16:24267220-24267608
  hyper
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccag

SEQ ID NO: 4338 - DNA, 971 bp, Homo sapiens
  chr16:25703152-25704123
  hyper
cgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgc

SEQ ID NO: 4339 - DNA, 255 bp, Homo sapiens
  chr16:25704389-25704644
  hyper
cgcgtgcacccggacgtgcgggcggtgggcgtagagccgcacttcttcgacaggaactacgaaaaggggttggagtggtacaggtaggaccctgggctccgcgggctggtggagacgcgtgggggagacgcggaggggaagccgcggctttccacgcccttcgagcatccaggcaccgtcccgagaggcccaagcccccgcgagggctctgcaaaccctggcggcgttgctcagggggatcggctgagagggctg

SEQ ID NO: 4340 - DNA, 4 bp, Homo sapiens
  chr16:31228309-31228313
  hyper
tctc

SEQ ID NO: 4341 - DNA, 259 bp, Homo sapiens
  chr16:31580480-31580739
  hyper
tctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcct

SEQ ID NO: 4342 - DNA, 340 bp, Homo sapiens
  chr16:49309108-49309448
  hyper
tgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgca

SEQ ID NO: 4343 - DNA, 523 bp, Homo sapiens
  chr16:49311467-49311990
  hyper
acagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 4344 - DNA, 199 bp, Homo sapiens
  chr16:49312032-49312231
  hyper
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaa

SEQ ID NO: 4345 - DNA, 347 bp, Homo sapiens
  chr16:49313363-49313710
  hyper
cccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacat

SEQ ID NO: 4346 - DNA, 625 bp, Homo sapiens
  chr16:49313936-49314561
  hyper
ccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtc

SEQ ID NO: 4347 - DNA, 552 bp, Homo sapiens; identical to SEQ ID NO: 1266
  chr16:49315764-49316316
  hyper

SEQ ID NO: 4348 - DNA, 100 bp, Homo sapiens
  chr16:51184324-51184424
  hyper
ttgtgggaagagatgcggagataaattttgcgagccagaccccgacactttccccgtccgtttgcaccgtctccggaacaactggcggccagcagcactc

SEQ ID NO: 4349 - DNA, 188 bp, Homo sapiens
  chr16:51184770-51184958
  hyper
ccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 4350 - DNA, 238 bp, Homo sapiens
  chr16:51185054-51185292
  hyper
cggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccc

SEQ ID NO: 4351 - DNA, 423 bp, Homo sapiens
  chr16:51185542-51185965
  hyper
gggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgc

SEQ ID NO: 4352 - DNA, 200 bp, Homo sapiens
  chr16:51186025-51186225
  hyper
cgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccagga

SEQ ID NO: 4353 - DNA, 176 bp, Homo sapiens
  chr16:54628691-54628867
  hyper
gggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccc

SEQ ID NO: 4354 - DNA, 66 bp, Homo sapiens
  chr16:54967141-54967207
  hyper
ccggcgggccctccccggctgggccagcggcggcgcggctggcggaggacccggcccctcactacc

SEQ ID NO: 4355 - DNA, 87 bp, Homo sapiens; identical to SEQ ID NO: 1267
  chr16:55363136-55363223
  hyper

SEQ ID NO: 4356 - DNA, 225 bp, Homo sapiens
  chr16:56224557-56224782
  hyper
ggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 4357 - DNA, 10 bp, Homo sapiens
  chr16:56224783-56224793
  hyper
ggtttattcc

SEQ ID NO: 4358 - DNA, 39 bp, Homo sapiens
  chr16:56224794-56224833
  hyper
acccactaccacatcgcgtttcctgaggtaacccggcct

SEQ ID NO: 4359 - DNA, 89 bp, Homo sapiens
  chr16:56224880-56224969
  hyper
cgggcgacaagatggagagccggcccgagagggacagaggccgcgctggcagcgagctggggggcccacctgaccgtcctgcgggcagc

SEQ ID NO: 4360 - DNA, 610 bp, Homo sapiens; identical to SEQ ID NO: 1268
  chr16:56659128-56659738
  hyper

SEQ ID NO: 4361 - DNA, 30 bp, Homo sapiens; identical to SEQ ID NO: 1269
  chr16:56672513-56672543
  hyper

SEQ ID NO: 4362 - DNA, 317 bp, Homo sapiens
  chr16:58018579-58018896
  hyper
acgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcag

SEQ ID NO: 4363 - DNA, 271 bp, Homo sapiens
  chr16:58019164-58019435
  hyper
ctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccct

SEQ ID NO: 4364 - DNA, 262 bp, Homo sapiens
  chr16:66461578-66461840
  hyper
gaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagc

SEQ ID NO: 4365 - DNA, 245 bp, Homo sapiens
  chr16:68676360-68676605
  hyper
aagtggttggcacatcgccggctgtcagcaaatgtttttgaaatgaatgaatgagtgaatgaccgacaaggggagctaaggggaaggcagcggtgcggtccgcgtcgcaggcagaagagctgactctccaatctccgctcctctctccgcccccgtccggaatgctgagtgcccgagaaggaggcggaaatgagcgcgctcaacagcccaccagccgggtgtttacttaattagggcctgcatcc

SEQ ID NO: 4366 - DNA, 15 bp, Homo sapiens
  chr16:68676841-68676856
  hyper
cgtggtccaccccca

SEQ ID NO: 4367 - DNA, 110 bp, Homo sapiens; identical to SEQ ID NO: 1270
  chr16:71459979-71460089
  hyper

SEQ ID NO: 4368 - DNA, 81 bp, Homo sapiens; identical to SEQ ID NO: 1271
  chr16:71460270-71460351
  hyper

SEQ ID NO: 4369 - DNA, 85 bp, Homo sapiens
  chr16:77822334-77822419
  hyper
ctggagttgaggcttcgttgggacaggaaagaagggtggggcgggggtgaagcgcttagggcacggctcttgtgaggattacggc

SEQ ID NO: 4370 - DNA, 688 bp, Homo sapiens
  chr16:77822420-77823108
  hyper
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtc

SEQ ID NO: 4371 - DNA, 152 bp, Homo sapiens
  chr16:86320901-86321053
  hyper
ccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcat

SEQ ID NO: 4372 - DNA, 46 bp, Homo sapiens
  chr16:86530947-86530993
  hyper
ccgagccccgagtcccggcaacgcgccccgggtgctccggtccact

SEQ ID NO: 4373 - DNA, 273 bp, Homo sapiens
  chr16:86531016-86531289
  hyper
cggccgaggtggcttcgggtggctctgaagcctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccgg

SEQ ID NO: 4374 - DNA, 107 bp, Homo sapiens
  chr16:86531374-86531481
  hyper
cgggaggtgagacgcagcctgggacctccggcctggggttggaggcccacgcttgctggggtgggcttttggtggaggaagagcaatcatgcggagggctctgccgc

SEQ ID NO: 4375 - DNA, 93 bp, Homo sapiens
  chr16:86531527-86531620
  hyper
cgttccctggttcacaaccaccccacccccacgcgcctgtgcacatgtccctcccgccgcgcagggtctccgcgggcgcgccccgccccaaat

SEQ ID NO: 4376 - DNA, 56 bp, Homo sapiens; identical to SEQ ID NO: 1272
  chr16:86544502-86544558
  hyper

SEQ ID NO: 4377 - DNA, 364 bp, Homo sapiens; identical to SEQ ID NO: 1273
  chr16:86599480-86599844
  hyper

SEQ ID NO: 4378 - DNA, 95 bp, Homo sapiens
  chr17:5000401-5000496
  hyper
gagcagcctcagcagcgcaggtggacacagtcgtcaaccactcgctggccgcctgcgacgtgaagcacctgcgctgggcgcggcgggtaagcgcc

SEQ ID NO: 4379 - DNA, 246 bp, Homo sapiens
  chr17:6616637-6616883
  hyper
cagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 4380 - DNA, 174 bp, Homo sapiens
  chr17:6616884-6617058
  hyper
cttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttc

SEQ ID NO: 4381 - DNA, 48 bp, Homo sapiens; identical to SEQ ID NO: 1274
  chr17:8868620-8868668
  hyper

SEQ ID NO: 4382 - DNA, 399 bp, Homo sapiens; identical to SEQ ID NO: 1275
  chr17:8868814-8869213
  hyper

SEQ ID NO: 4383 - DNA, 171 bp, Homo sapiens; identical to SEQ ID NO: 1276
  chr17:8869214-8869385
  hyper

SEQ ID NO: 4384 - DNA, 434 bp, Homo sapiens; identical to SEQ ID NO: 1277
  chr17:8907294-8907728
  hyper

SEQ ID NO: 4385 - DNA, 22 bp, Homo sapiens
  chr17:8907776-8907798
  hyper
cgggtgacggaggctttatcct

SEQ ID NO: 4386 - DNA, 15 bp, Homo sapiens
  chr17:10101095-10101110
  hyper
actccggggtggaga

SEQ ID NO: 4387 - DNA, 317 bp, Homo sapiens; identical to SEQ ID NO: 1280
  chr17:10101131-10101448
  hyper

SEQ ID NO: 4388 - DNA, 106 bp, Homo sapiens
  chr17:13505466-13505572
  hyper
tcccccattcctccccgcggcttcgcccccttccagtggatccggtgtctgcggcggctccggggttgcctgagtgacagctaaggccggccggatctctgggggc

SEQ ID NO: 4389 - DNA, 289 bp, Homo sapiens
  chr17:29249650-29249939
  hyper
ccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 4390 - DNA, 118 bp, Homo sapiens; identical to SEQ ID NO: 1281
  chr17:31618291-31618409
  hyper

SEQ ID NO: 4391 - DNA, 344 bp, Homo sapiens; identical to SEQ ID NO: 1282
  chr17:31618410-31618754
  hyper

SEQ ID NO: 4392 - DNA, 383 bp, Homo sapiens
  chr17:31618954-31619337
  hyper
gatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggct

SEQ ID NO: 4393 - DNA, 85 bp, Homo sapiens
  chr17:32907620-32907705
  hyper
cttggaggaagaaagcggcgctatccatgtgcggttactaccgaaaccgaggaaactggggattgcgttggaagtcggcaccctc

SEQ ID NO: 4394 - DNA, 99 bp, Homo sapiens
  chr17:32907706-32907805
  hyper
agtgagttcggattcgagctgggccgtgaggccgggagattcagcactgggctctaggtagcccccgggacgcccgcggccaccgggctccggactgca

SEQ ID NO: 4395 - DNA, 274 bp, Homo sapiens
  chr17:32907873-32908147
  hyper
cgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcag

SEQ ID NO: 4396 - DNA, 204 bp, Homo sapiens
  chr17:32908170-32908374
  hyper
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtg

SEQ ID NO: 4397 - DNA, 349 bp, Homo sapiens
  chr17:32908582-32908931
  hyper
gcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcggg

SEQ ID NO: 4398 - DNA, 475 bp, Homo sapiens
  chr17:35294006-35294481
  hyper
gaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgc

SEQ ID NO: 4399 - DNA, 9 bp, Homo sapiens
  chr17:35294482-35294491
  hyper
gggctgtgc

SEQ ID NO: 4400 - DNA, 1133 bp, Homo sapiens
  chr17:35294492-35295625
  hyper
cccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctc

SEQ ID NO: 4401 - DNA, 430 bp, Homo sapiens
  chr17:35296716-35297146
  hyper
cgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 4402 - DNA, 90 bp, Homo sapiens
  chr17:35297147-35297237
  hyper
cgcacgtttatatagagttctaattgtaattcgacttttctgaatctaatcggaaaataagtgccccgttccccccgcccacacaggtca

SEQ ID NO: 4403 - DNA, 228 bp, Homo sapiens; identical to SEQ ID NO: 1283
  chr17:35297936-35298164
  hyper

SEQ ID NO: 4404 - DNA, 259 bp, Homo sapiens; identical to SEQ ID NO: 1284
  chr17:35299185-35299444
  hyper

SEQ ID NO: 4405 - DNA, 89 bp, Homo sapiens; identical to SEQ ID NO: 1285
  chr17:35299600-35299689
  hyper

SEQ ID NO: 4406 - DNA, 56 bp, Homo sapiens; identical to SEQ ID NO: 1286
  chr17:35299910-35299966
  hyper

SEQ ID NO: 4407 - DNA, 453 bp, Homo sapiens; identical to SEQ ID NO: 1287
  chr17:35300260-35300713
  hyper

SEQ ID NO: 4408 - DNA, 30 bp, Homo sapiens; identical to SEQ ID NO: 1288
  chr17:35300812-35300842
  hyper

SEQ ID NO: 4409 - DNA, 210 bp, Homo sapiens; identical to SEQ ID NO: 1289
  chr17:35303325-35303535
  hyper

SEQ ID NO: 4410 - DNA, 63 bp, Homo sapiens
  chr17:36103540-36103603
  hyper
gccaaggctcagccccgaaatcgcggcgcttcagtgtccgaagccacgcgatgggctctgtcc

SEQ ID NO: 4411 - DNA, 334 bp, Homo sapiens
  chr17:36104217-36104551
  hyper
cgcgtgggcaaacctcccggcaaagggctccacagctccagttctccccggcccagccccagccccgcggggaaaagcccttgggtctcggacgctggcctgggcctggggagaagaagcccggtgggccgcagggtcgtcccgctaagggattgggaagggtccgggtgttgggagagaagcagagcgccccccgggggacttctctggtgggaaacgggcttggcgagtgtggtcgggcgcagtgtcactcaggcccggggccggggctccaggggttcgggtgggtcccctccacctcgctctgcgcctacctgagcatccggtccacctc

SEQ ID NO: 4412 - DNA, 189 bp, Homo sapiens
  chr17:36104643-36104832
  hyper
cgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcaggg

SEQ ID NO: 4413 - DNA, 213 bp, Homo sapiens
  chr17:36105137-36105350
  hyper
ggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccac

SEQ ID NO: 4414 - DNA, 254 bp, Homo sapiens
  chr17:36105458-36105712
  hyper
cgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtag

SEQ ID NO: 4415 - DNA, 327 bp, Homo sapiens
  chr17:37321298-37321625
  hyper
gctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 4416 - DNA, 78 bp, Homo sapiens
  chr17:37321787-37321865
  hyper
cgccgggacccaagaggagcaggcagggacgggggcaggggaggccgcggggcagtcgaggagcgcccatatacgacc

SEQ ID NO: 4417 - DNA, 462 bp, Homo sapiens
  chr17:37366090-37366552
  hyper
cccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcc

SEQ ID NO: 4418 - DNA, 423 bp, Homo sapiens; identical to SEQ ID NO: 1290
  chr17:37381007-37381430
  hyper

SEQ ID NO: 4419 - DNA, 157 bp, Homo sapiens; identical to SEQ ID NO: 1291
  chr17:37381570-37381727
  hyper

SEQ ID NO: 4420 - DNA, 292 bp, Homo sapiens; identical to SEQ ID NO: 1292
  chr17:37381825-37382117
  hyper

SEQ ID NO: 4421 - DNA, 196 bp, Homo sapiens
  chr17:42393910-42394106
  hyper
gcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctccccca

SEQ ID NO: 4422 - DNA, 466 bp, Homo sapiens; identical to SEQ ID NO: 1293
  chr17:42635294-42635760
  hyper

SEQ ID NO: 4423 - DNA, 343 bp, Homo sapiens
  chr17:42733556-42733899
  hyper
cacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctga

SEQ ID NO: 4424 - DNA, 96 bp, Homo sapiens; identical to SEQ ID NO: 1294
  chr17:43047752-43047848
  hyper

SEQ ID NO: 4425 - DNA, 258 bp, Homo sapiens
  chr17:43339641-43339899
  hyper
cctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctc

SEQ ID NO: 4426 - DNA, 127 bp, Homo sapiens
  chr17:43974231-43974358
  hyper
gtgatgaacctggtacgcacggttttctggttaattctatcgctgaaaactggtgcggggggcgcacttctgagacggaagagcatctaggagctgaatcctccacgcgggtcgcccaggttgatct

SEQ ID NO: 4427 - DNA, 569 bp, Homo sapiens
  chr17:45810772-45811341
  hyper
ggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcct

SEQ ID NO: 4428 - DNA, 811 bp, Homo sapiens
  chr17:46620623-46621434
  hyper
cttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaact

SEQ ID NO: 4429 - DNA, 324 bp, Homo sapiens; identical to SEQ ID NO: 1295
  chr17:46655070-46655394
  hyper

SEQ ID NO: 4430 - DNA, 24 bp, Homo sapiens
  chr17:46655395-46655419
  hyper
gcgcaggagcccgaggggacagac

SEQ ID NO: 4431 - DNA, 111 bp, Homo sapiens; identical to SEQ ID NO: 1297
  chr17:46655450-46655561
  hyper

SEQ ID NO: 4432 - DNA, 437 bp, Homo sapiens; identical to SEQ ID NO: 1298
  chr17:46655562-46655999
  hyper

SEQ ID NO: 4433 - DNA, 341 bp, Homo sapiens; identical to SEQ ID NO: 1299
  chr17:46656057-46656398
  hyper

SEQ ID NO: 4434 - DNA, 480 bp, Homo sapiens
  chr17:46659429-46659909
  hyper
gccacaggttgctagcgtgacctcgcccctcccagccaccctccgccgtccaggcgtgcccagtccgctaggaatcatcaccttttgttggcggggagaagggactcagcgagggagcgaaaccgaaggcccgagcggaggcgagtccccagccggcctgcgcaccggcggcggcggcgcggaggagagaaaggcccagagggggcgcgggcgagggtactcaccgggaggctccccagccccgccggccgccgagccgcccgcggacgcgccgggcaacagctgagctctctcctgtccactattgtgtgtccggaaaaccggaccgcggcggcggacacagccacgggctccctcagaagccggaacgtgacttttttttttggtgtgtttttgttttggaagcgcaagttttcgtgttaatctcatactttggcagtctttgttaaacagctaggcgcgtcacgaggctctcaaaca

SEQ ID NO: 4435 - DNA, 37 bp, Homo sapiens
  chr17:46674933-46674970
  hyper
acagcgagagacccccggccggcgcccaatcttcttc

SEQ ID NO: 4436 - DNA, 393 bp, Homo sapiens
  chr17:46675170-46675563
  hyper
cacgctcttgtcctgcgcgcagtccgacttccgcggctcggggtggaacgggggctgctcgtcggcgccggagagtgcgcaggccgactctttctcgcggtagaaggccggcgccggcccgtagtcgcagggcgccgctcggccgtagccaccgcccgccggcgggtaataggaggaagtggcaaagcccttgtcctggcccggccctggcccgtagggcgcggggtaatgtctcagcgggtccgcatagcccgacgaatagagcggtagctggcccaggaaggactcctgcccgctggccagagtgacggggaaggtggagttcacgaaataggaactcattgggaggggaggcgcgcgcggccgctgctgctccgccgggtttatgatttg

SEQ ID NO: 4437 - DNA, 238 bp, Homo sapiens
  chr17:46690467-46690705
  hyper
gggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctc

SEQ ID NO: 4438 - DNA, 28 bp, Homo sapiens
  chr17:46690852-46690880
  hyper
cgcctgcgtccggcggctgctgggaatg

SEQ ID NO: 4439 - DNA, 6 bp, Homo sapiens
  chr17:46691813-46691819
  hyper
aattgc

SEQ ID NO: 4440 - DNA, 378 bp, Homo sapiens
  chr17:46691987-46692365
  hyper
cgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccacc

SEQ ID NO: 4441 - DNA, 938 bp, Homo sapiens; identical to SEQ ID NO: 1300
  chr17:46795436-46796374
  hyper

SEQ ID NO: 4442 - DNA, 55 bp, Homo sapiens; identical to SEQ ID NO: 1301
  chr17:46796498-46796553
  hyper

SEQ ID NO: 4443 - DNA, 25 bp, Homo sapiens
  chr17:46796613-46796638
  hyper
cagcactactaccgtctgagcaggc

SEQ ID NO: 4444 - DNA, 74 bp, Homo sapiens
  chr17:46797140-46797214
  hyper
ttttagctgcaggcccggcgggtgttccccggaaggcaaggattggaagctctttgataaagccgcgcgaggcc

SEQ ID NO: 4445 - DNA, 31 bp, Homo sapiens
  chr17:46797274-46797305
  hyper
cgtctcggcctggctccggaggggtgaagga

SEQ ID NO: 4446 - DNA, 197 bp, Homo sapiens
  chr17:46800518-46800715
  hyper
tttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggg

SEQ ID NO: 4447 - DNA, 87 bp, Homo sapiens
  chr17:46800961-46801048
  hyper
atttggagtagggatcgcctgcagggaaggcggggcggattctcggctggcggcggcctcgcagggttcccggaagcgctagccagc

SEQ ID NO: 4448 - DNA, 169 bp, Homo sapiens
  chr17:46801108-46801277
  hyper
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgaga

SEQ ID NO: 4449 - DNA, 606 bp, Homo sapiens; identical to SEQ ID NO: 1303
  chr17:46802306-46802912
  hyper

SEQ ID NO: 4450 - DNA, 117 bp, Homo sapiens; identical to SEQ ID NO: 1304
  chr17:46802993-46803110
  hyper

SEQ ID NO: 4451 - DNA, 318 bp, Homo sapiens; identical to SEQ ID NO: 1305
  chr17:46804107-46804425
  hyper

SEQ ID NO: 4452 - DNA, 728 bp, Homo sapiens
  chr17:46810368-46811096
  hyper
tcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 4453 - DNA, 213 bp, Homo sapiens
  chr17:46816511-46816724
  hyper
gccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacgg

SEQ ID NO: 4454 - DNA, 347 bp, Homo sapiens; identical to SEQ ID NO: 1306
  chr17:46824568-46824915
  hyper

SEQ ID NO: 4455 - DNA, 469 bp, Homo sapiens; identical to SEQ ID NO: 1307
  chr17:46824916-46825385
  hyper

SEQ ID NO: 4456 - DNA, 63 bp, Homo sapiens
  chr17:46826997-46827060
  hyper
aaagacctcagtcctcgcatccccaccccgacccccggcagcctctttcgctctaagcctcag

SEQ ID NO: 4457 - DNA, 121 bp, Homo sapiens
  chr17:46827381-46827502
  hyper
ggtctggagggctggcggggcaggagttgggggccaggtaggaaagccaggggtcgaagggatcgattctaggggccgcagaggctactctcgtgctctggagaagcaccgcatctttctc

SEQ ID NO: 4458 - DNA, 49 bp, Homo sapiens
  chr17:46827625-46827674
  hyper
cgccagcattttgccggggtttatgcctcaatcccgcattccagccact

SEQ ID NO: 4459 - DNA, 157 bp, Homo sapiens
  chr17:46829979-46830136
  hyper
ccccaggttggttcacgcgagttttaaaatgaatcggaggtgaaatggagctcattaccctctcttcagcccgaccctcaatctttggcagcgaggggcagttatgggacggggggcgggtgggaagagcgcccagggccccctccgggttctccca

SEQ ID NO: 4460 - DNA, 502 bp, Homo sapiens; identical to SEQ ID NO: 1308
  chr17:46831824-46832326
  hyper

SEQ ID NO: 4461 - DNA, 150 bp, Homo sapiens; identical to SEQ ID NO: 1309
  chr17:46832489-46832639
  hyper

SEQ ID NO: 4462 - DNA, 198 bp, Homo sapiens
  chr17:47074751-47074949
  hyper
cattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgcc

SEQ ID NO: 4463 - DNA, 177 bp, Homo sapiens; identical to SEQ ID NO: 1310
  chr17:47075225-47075402
  hyper

SEQ ID NO: 4464 - DNA, 589 bp, Homo sapiens
  chr17:47987525-47988114
  hyper
ggaggtgagaggaaccgcgaggcagcagcggtgtggggaaggcactcagctttcctggaggagcggctcccggtggcggcgggctgcctggaggaggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccgaggggtggaaccttgcggtgagctcggcgcggcgccccctccccgagctccggcccagcggcgctctcagctggttcccacgctgcgcagcgctggccacgacccctcgtcccttctccacctgggtctgcctcttggctcgctgactgcaagcctggcagcgcgcacgcgcacacttcctcca

SEQ ID NO: 4465 - DNA, 239 bp, Homo sapiens; identical to SEQ ID NO: 1311
  chr17:48042409-48042648
  hyper

SEQ ID NO: 4466 - DNA, 206 bp, Homo sapiens; identical to SEQ ID NO: 1312
  chr17:48042750-48042956
  hyper

SEQ ID NO: 4467 - DNA, 1027 bp, Homo sapiens; identical to SEQ ID NO: 1313
  chr17:48049499-48050526
  hyper

SEQ ID NO: 4468 - DNA, 53 bp, Homo sapiens
  chr17:48071806-48071859
  hyper
cgatcctcatccgggaccgcggcgcactgcgcacatcgcgccccaaatgcttg

SEQ ID NO: 4469 - DNA, 534 bp, Homo sapiens
  chr17:48636701-48637235
  hyper
tggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacga

SEQ ID NO: 4470 - DNA, 197 bp, Homo sapiens
  chr17:53341227-53341424
  hyper
cgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttat

SEQ ID NO: 4471 - DNA, 70 bp, Homo sapiens
  chr17:58217229-58217299
  hyper
ttccagggtaaagaccgcggaaccaggcgggggtctggggagcctggctgcgacctcggctgcaggcttc

SEQ ID NO: 4472 - DNA, 249 bp, Homo sapiens
  chr17:58217356-58217605
  hyper
cgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctct

SEQ ID NO: 4473 - DNA, 200 bp, Homo sapiens
  chr17:58498777-58498977
  hyper
gtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 4474 - DNA, 355 bp, Homo sapiens
  chr17:58498978-58499333
  hyper
ggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcgg

SEQ ID NO: 4475 - DNA, 71 bp, Homo sapiens
  chr17:59474176-59474247
  hyper
actcggacgcaagtccgtcgtccgctctgccacgcggccgcacagcccgagcttcctgctgcccactgccc

SEQ ID NO: 4476 - DNA, 403 bp, Homo sapiens
  chr17:59474741-59475144
  hyper
cgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggacca

SEQ ID NO: 4477 - DNA, 414 bp, Homo sapiens; identical to SEQ ID NO: 1314
  chr17:59478133-59478547
  hyper

SEQ ID NO: 4478 - DNA, 275 bp, Homo sapiens; identical to SEQ ID NO: 1315
  chr17:59528876-59529151
  hyper

SEQ ID NO: 4479 - DNA, 12 bp, Homo sapiens
  chr17:59529253-59529265
  hyper
cgacctcgggac

SEQ ID NO: 4480 - DNA, 233 bp, Homo sapiens; identical to SEQ ID NO: 1317
  chr17:59529843-59530076
  hyper

SEQ ID NO: 4481 - DNA, 49 bp, Homo sapiens
  chr17:59530303-59530352
  hyper
caaggaagagggccccggtactggagcgaaaatccgtgtagatatgtga

SEQ ID NO: 4482 - DNA, 207 bp, Homo sapiens
  chr17:59531811-59532018
  hyper
accccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcct

SEQ ID NO: 4483 - DNA, 170 bp, Homo sapiens; identical to SEQ ID NO: 1318
  chr17:59533874-59534044
  hyper

SEQ ID NO: 4484 - DNA, 66 bp, Homo sapiens; identical to SEQ ID NO: 1319
  chr17:59534340-59534406
  hyper

SEQ ID NO: 4485 - DNA, 225 bp, Homo sapiens; identical to SEQ ID NO: 1320
  chr17:59534556-59534781
  hyper

SEQ ID NO: 4486 - DNA, 21 bp, Homo sapiens
  chr17:61778053-61778074
  hyper
cccgccgccaggggccgcccc

SEQ ID NO: 4487 - DNA, 15 bp, Homo sapiens
  chr17:61778234-61778249
  hyper
ggtatgcgtggttcc

SEQ ID NO: 4488 - DNA, 153 bp, Homo sapiens
  chr17:61926172-61926325
  hyper
ccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 4489 - DNA, 96 bp, Homo sapiens
  chr17:61926507-61926603
  hyper
cgcgctcccctcccgtcgttgtagcttcctgctcgcccctctcatctcagccaaccctgctgagctttcgcgtgggcgtcacgagtttctaggcag

SEQ ID NO: 4490 - DNA, 21 bp, Homo sapiens
  chr17:70113546-70113567
  hyper
cttccacaagaaactcgtgtc

SEQ ID NO: 4491 - DNA, 372 bp, Homo sapiens; identical to SEQ ID NO: 1322
  chr17:70113647-70114019
  hyper

SEQ ID NO: 4492 - DNA, 365 bp, Homo sapiens; identical to SEQ ID NO: 1323
  chr17:70114152-70114517
  hyper

SEQ ID NO: 4493 - DNA, 640 bp, Homo sapiens; identical to SEQ ID NO: 1324
  chr17:70215667-70216307
  hyper

SEQ ID NO: 4494 - DNA, 54 bp, Homo sapiens; identical to SEQ ID NO: 1325
  chr17:70216392-70216446
  hyper

SEQ ID NO: 4495 - DNA, 525 bp, Homo sapiens
  chr17:71948390-71948915
  hyper
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctcc

SEQ ID NO: 4496 - DNA, 324 bp, Homo sapiens
  chr17:72856941-72857265
  hyper
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacga

SEQ ID NO: 4497 - DNA, 38 bp, Homo sapiens; identical to SEQ ID NO: 1326
  chr17:74072998-74073036
  hyper

SEQ ID NO: 4498 - DNA, 144 bp, Homo sapiens
  chr17:74534219-74534363
  hyper
acactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccg

SEQ ID NO: 4499 - DNA, 15 bp, Homo sapiens
  chr17:74534387-74534402
  hyper
cgcccaggctctggg

SEQ ID NO: 4500 - DNA, 567 bp, Homo sapiens
  chr17:74865591-74866158
  hyper
ccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgg

SEQ ID NO: 4501 - DNA, 18 bp, Homo sapiens
  chr17:75369440-75369458
  hyper
gcctaggggctcctccgg

SEQ ID NO: 4502 - DNA, 228 bp, Homo sapiens; identical to SEQ ID NO: 1328
  chr17:75369492-75369720
  hyper

SEQ ID NO: 4503 - DNA, 389 bp, Homo sapiens
  chr17:76227773-76228162
  hyper
agggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcg

SEQ ID NO: 4504 - DNA, 130 bp, Homo sapiens
  chr17:76228213-76228343
  hyper
cggacgccggcaatggcagcgcctggcccgggcgcgcagagctgctctcctcgcactcggggctctggcgcatctgcgaaggtaaccggccaccgcgccggccctcctccctccgcgacctcgtccctcc

SEQ ID NO: 4505 - DNA, 102 bp, Homo sapiens
  chr17:77178962-77179064
  hyper
cgctccccgccccgagtccccagcggcccggcgcgaagttccccaaagtgacccgggcgccgagaacccccgccccctcccctcgggcttccccggagactc

SEQ ID NO: 4506 - DNA, 249 bp, Homo sapiens
  chr17:77179081-77179330
  hyper
cgcgccttcggaaaagttgcgagcgacgccccaaactccggcccccccgcctcgcgccgcgcgcgccctgggcgcccccgcgctcggccgccgcgcaggggcgcagttccccctaccccagccccggcgccatgacgcggggagcgcagcgggggccaccggtggcggcggcggcgcagaggcggccaagtgcggggcgtgggcggcagcgcggggcgcacgtgcgccgggccgggggccggggccggg

SEQ ID NO: 4507 - DNA, 75 bp, Homo sapiens
  chr17:77179380-77179455
  hyper
cggagtgcgggagcatgctgccggagttggacagcaggaggcagcccgagttcgccatggagcacagcatggggc

SEQ ID NO: 4508 - DNA, 27 bp, Homo sapiens
  chr17:77179456-77179483
  hyper
gcaggggggcgcccggcggcggctctg

SEQ ID NO: 4509 - DNA, 92 bp, Homo sapiens
  chr17:77179617-77179709
  hyper
cgcgcctctgcccggtgttccccctgcccgggcggggaggctggagagagcgcgcgcgagaatacggccagagagtctgtgcgcgagagatc

SEQ ID NO: 4510 - DNA, 25 bp, Homo sapiens
  chr17:77179710-77179735
  hyper
ggcgagcgggcgagagcaggagtca

SEQ ID NO: 4511 - DNA, 64 bp, Homo sapiens
  chr17:77777585-77777649
  hyper
acttttttgctgggacgtcgggacctcaagtcagttccaaagtgggagtctctcagccggtgcc

SEQ ID NO: 4512 - DNA, 254 bp, Homo sapiens
  chr17:77777650-77777904
  hyper
ttcccttgcgagattgttaacgccaagagccacagtccagcttccccttttagagatcagaaaatcctaagtgcagggcctgccgggtcattcgagaaggcacaagctgcggaggccagtctggggcctctcgcagaacctcggggaacagaggcgtctgccgggccgcctaccctccgcaagagtgggccacgcgggcggcaaacccgagggcagacgtttgggagctgaccgagaaaacgcgacggtgccgg

SEQ ID NO: 4513 - DNA, 18 bp, Homo sapiens
  chr17:77777943-77777961
  hyper
cgacgcctttcctcgcag

SEQ ID NO: 4514 - DNA, 263 bp, Homo sapiens
  chr17:80329738-80330001
  hyper
gtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 4515 - DNA, 890 bp, Homo sapiens
  chr18:500373-501263
  hyper
gcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcgccgctctcgctctcccagcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 4516 - DNA, 171 bp, Homo sapiens
  chr18:906736-906907
  hyper
tccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagc

SEQ ID NO: 4517 - DNA, 270 bp, Homo sapiens
  chr18:3499101-3499371
  hyper
agggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcac

SEQ ID NO: 4518 - DNA, 68 bp, Homo sapiens
  chr18:5196575-5196643
  hyper
cgcctccttctcctcgggaggccaggaggacccgggtcactttgccaattctgcggagggggaagtag

SEQ ID NO: 4519 - DNA, 199 bp, Homo sapiens
  chr18:11149561-11149760
  hyper
cttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctg

SEQ ID NO: 4520 - DNA, 52 bp, Homo sapiens
  chr18:11149779-11149831
  hyper
cgcgggcactcctgccccactggctcccgcagccccgcggctctgcgtggtt

SEQ ID NO: 4521 - DNA, 252 bp, Homo sapiens
  chr18:11752127-11752379
  hyper
ggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctct

SEQ ID NO: 4522 - DNA, 6 bp, Homo sapiens
  chr18:11752599-11752605
  hyper
ggctcc

SEQ ID NO: 4523 - DNA, 90 bp, Homo sapiens
  chr18:11752640-11752730
  hyper
cgccaggctgggcgggcagggccgggcgagggtcgcgcgcacctctgggccgcggagcccagacggcggccggggcgagctcctccagcc

SEQ ID NO: 4524 - DNA, 148 bp, Homo sapiens
  chr18:12254432-12254580
  hyper
cgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatcc

SEQ ID NO: 4525 - DNA, 324 bp, Homo sapiens; identical to SEQ ID NO: 1329
  chr18:12307602-12307926
  hyper

SEQ ID NO: 4526 - DNA, 350 bp, Homo sapiens; identical to SEQ ID NO: 1330
  chr18:13868570-13868920
  hyper

SEQ ID NO: 4527 - DNA, 459 bp, Homo sapiens
  chr18:22929260-22929719
  hyper
cgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggc

SEQ ID NO: 4528 - DNA, 357 bp, Homo sapiens
  chr18:22929926-22930283
  hyper
ggacctcgcggctcccctcggccgcccgcccccgatttcctcggaaggaggctcgcgaaggtggaggaggcggccgaggaggaggaggaggccgccacgtgactctcctcgccacattccaacacagccatcagatcgataacttcagggacccccgcccccgccgcagccagctagtgcgcccccaaaatcccgcacgcacgccccgcaacttccctctccaacagggacgacggagagctggaccccaccgcgaaacgcaaaggactccaggggcggcggggagaagtaggggcgaggggcggtcaacttctgggaatggccaagaggggtgctctgaggcccgagccggggtcc

SEQ ID NO: 4529 - DNA, 865 bp, Homo sapiens
  chr18:22930284-22931149
  hyper
gtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaa

SEQ ID NO: 4530 - DNA, 125 bp, Homo sapiens
  chr18:28620831-28620956
  hyper
gttaatttacccatccggtccgaaattgcaagtgtttgtaaactgacaattgcagatgaaatagtcattttctgtgcactttccggtatttaagtctccagatacagcatttaacctaaactcaa

SEQ ID NO: 4531 - DNA, 135 bp, Homo sapiens
  chr18:28621033-28621168
  hyper
cgcgcaccttcttccttgccacagctcgacacccccacccatgccttgccgggaaagctcctggtcttccatggcctctgggagcctcgagcgaatgcgagaaattctgagagcagcacccgtagtttcgttccc

SEQ ID NO: 4532 - DNA, 279 bp, Homo sapiens
  chr18:28621709-28621988
  hyper
tctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgct

SEQ ID NO: 4533 - DNA, 63 bp, Homo sapiens
  chr18:31020448-31020511
  hyper
gggtgaagaactagtcgactctaactccctcagggtggccagggaattgcatttggttctccc

SEQ ID NO: 4534 - DNA, 526 bp, Homo sapiens; identical to SEQ ID NO: 1331
  chr18:31739116-31739642
  hyper

SEQ ID NO: 4535 - DNA, 122 bp, Homo sapiens
  chr18:35065024-35065146
  hyper
gctataaaccagggccgaggcgcgatagtttatcaaagacgagggctggctccttaaataaaccgcggtgatctcacttgcggcgccccctcccacgccggccccctcctcccccactagag

SEQ ID NO: 4536 - DNA, 135 bp, Homo sapiens
  chr18:35065516-35065651
  hyper
cgctctgggccttcagcgctgactcacgctcgcagtaggtgaggaaggcgcagcctggggaggaaagcaagcgccaagaagggtcagtggggcgcccccgggcccgccgacgcgccctgccgcccgccctccagg

SEQ ID NO: 4537 - DNA, 262 bp, Homo sapiens; identical to SEQ ID NO: 1332
  chr18:44336188-44336450
  hyper

SEQ ID NO: 4538 - DNA, 164 bp, Homo sapiens; identical to SEQ ID NO: 1333
  chr18:44337012-44337176
  hyper

SEQ ID NO: 4539 - DNA, 202 bp, Homo sapiens; identical to SEQ ID NO: 1334
  chr18:44337416-44337618
  hyper

SEQ ID NO: 4540 - DNA, 193 bp, Homo sapiens; identical to SEQ ID NO: 1335
  chr18:44337649-44337842
  hyper

SEQ ID NO: 4541 - DNA, 140 bp, Homo sapiens; identical to SEQ ID NO: 1336
  chr18:44772977-44773117
  hyper

SEQ ID NO: 4542 - DNA, 501 bp, Homo sapiens; identical to SEQ ID NO: 1337
  chr18:44773466-44773967
  hyper

SEQ ID NO: 4543 - DNA, 277 bp, Homo sapiens
  chr18:44778049-44778326
  hyper
ggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 4544 - DNA, 68 bp, Homo sapiens
  chr18:44787746-44787814
  hyper
tagcttgctcagatccgcacccccccactccccacctcagacctctctgacgccgcctgttggtcagg

SEQ ID NO: 4545 - DNA, 98 bp, Homo sapiens
  chr18:44789865-44789963
  hyper
gccgggctccgcctccggaaggcgggcggggagggtagttgctgggggtccctaggccgggccccaggacatctaggacatgccgggggctgtttgct

SEQ ID NO: 4546 - DNA, 76 bp, Homo sapiens
  chr18:49867303-49867379
  hyper
tctcatttcatttggcgagtagtagaattggggtgggggatagcaagagatttggcgcttgcgctgcccccatttg

SEQ ID NO: 4547 - DNA, 139 bp, Homo sapiens
  chr18:52989807-52989946
  hyper
gggccccggcctccccggagctggtgggaagcgcggccgcccatgaacttcacctcgccccgccgcagacagccgcatgggcccagagcctacggaggggctggggcgctgctcccctcgctggcgctgggcgccccaa

SEQ ID NO: 4548 - DNA, 361 bp, Homo sapiens
  chr18:53256942-53257303
  hyper
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagagaggcggccaagatggcggtgctggtcgaccacgcctcctccgggagcggaggcgggtggctgttctcgggtaggcgtcgcgcgtggggcggcactgtgggagttcccgaggccgaggtcgttcgcaggccccatttccctgcgctcttattcgtgttgccgcttct

SEQ ID NO: 4549 - DNA, 609 bp, Homo sapiens; identical to SEQ ID NO: 1338
  chr18:53446866-53447475
  hyper

SEQ ID NO: 4550 - DNA, 57 bp, Homo sapiens; identical to SEQ ID NO: 1339
  chr18:53447798-53447855
  hyper

SEQ ID NO: 4551 - DNA, 102 bp, Homo sapiens
  chr18:55020597-55020699
  hyper
gcagagatggacaggcgtgaggggagcgccctccccgcgccctgtccgcagactccgcgggccgggcccggggcggtgctggcggtttaatggcgcaggcgc

SEQ ID NO: 4552 - DNA, 141 bp, Homo sapiens
  chr18:55020804-55020945
  hyper
cgcagccaccgccccccaccagctttccgggatttctgcaattcccccgccccctgcgggaagcgagcctcggaagggccgcccaccctcgccaggtcggagtcaccgctccgcgctgggccggcctgtgaaggctccagg

SEQ ID NO: 4553 - DNA, 277 bp, Homo sapiens
  chr18:55020965-55021242
  hyper
cgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccc

SEQ ID NO: 4554 - DNA, 133 bp, Homo sapiens
  chr18:56888490-56888623
  hyper
cccctagaacccaggcggagaggacggccgcgctgcgggtgcggagggcgcctgcgggtggggtcaggattccgccctgcgcgcactcgctgctttcgctcagctgggaggcaggaagcgcctggcagcctcg

SEQ ID NO: 4555 - DNA, 363 bp, Homo sapiens
  chr18:56934956-56935319
  hyper
gctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctg

SEQ ID NO: 4556 - DNA, 154 bp, Homo sapiens; identical to SEQ ID NO: 1340
  chr18:56939498-56939652
  hyper

SEQ ID NO: 4557 - DNA, 408 bp, Homo sapiens; identical to SEQ ID NO: 1341
  chr18:56939763-56940171
  hyper

SEQ ID NO: 4558 - DNA, 680 bp, Homo sapiens; identical to SEQ ID NO: 1342
  chr18:56940565-56941245
  hyper

SEQ ID NO: 4559 - DNA, 240 bp, Homo sapiens; identical to SEQ ID NO: 1343
  chr18:56941557-56941797
  hyper

SEQ ID NO: 4560 - DNA, 515 bp, Homo sapiens
  chr18:59000829-59001344
  hyper
ccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggtggaggacgtggcg

SEQ ID NO: 4561 - DNA, 208 bp, Homo sapiens
  chr18:59001497-59001705
  hyper
cgcacagagatgtgcgccgggaaggggaccagagagccaggctccggggaggcgcaggcacctacggggccgatccctggtccgtgcctcgcgccgcgcccccgccggagctcggctgtgggaggagaatgtggtgggtactcgagtccccgccacctgccggacttcgccaactccccggatttcctgtcctcgggccctgacactc

SEQ ID NO: 4562 - DNA, 235 bp, Homo sapiens
  chr18:60263660-60263895
  hyper
cgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatc

SEQ ID NO: 4563 - DNA, 155 bp, Homo sapiens
  chr18:67067500-67067655
  hyper
cctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttg

SEQ ID NO: 4564 - DNA, 182 bp, Homo sapiens; identical to SEQ ID NO: 1344
  chr18:70535373-70535555
  hyper

SEQ ID NO: 4565 - DNA, 80 bp, Homo sapiens; identical to SEQ ID NO: 1345
  chr18:70535575-70535655
  hyper

SEQ ID NO: 4566 - DNA, 264 bp, Homo sapiens
  chr18:74961385-74961649
  hyper
tcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcag

SEQ ID NO: 4567 - DNA, 78 bp, Homo sapiens; identical to SEQ ID NO: 1346
  chr18:77547970-77548048
  hyper

SEQ ID NO: 4568 - DNA, 258 bp, Homo sapiens; identical to SEQ ID NO: 1347
  chr18:77548351-77548609
  hyper

SEQ ID NO: 4569 - DNA, 415 bp, Homo sapiens; identical to SEQ ID NO: 1348
  chr18:77557982-77558397
  hyper

SEQ ID NO: 4570 - DNA, 726 bp, Homo sapiens; identical to SEQ ID NO: 1349
  chr18:77558416-77559142
  hyper

SEQ ID NO: 4571 - DNA, 72 bp, Homo sapiens
  chr19:1524442-1524514
  hyper
cgtgtccgtgggttgcgtgtccggggtgtgggcgtgcggctcggcctcgggatgcgacgctgtgttgcccct

SEQ ID NO: 4572 - DNA, 856 bp, Homo sapiens
  chr19:2252588-2253444
  hyper
cggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcg

SEQ ID NO: 4573 - DNA, 266 bp, Homo sapiens
  chr19:2290006-2290272
  hyper
ttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggc

SEQ ID NO: 4574 - DNA, 238 bp, Homo sapiens
  chr19:2290630-2290868
  hyper
ggggtggcgcaggccggcagccgcccgtcgaagttgagggtcttgcgacgctgcacgatccacagcaggcgacagtcgcaggccagcgggttcccgtccacgcgcagcgtctctagcgtgttcaccgagtggaaggtgctctcctccaacgtggagagcaggttgttggagaggttgagcaggcggatctggcgcaggcccaggaaggcctgcggctccaccacagccagcagggccc

SEQ ID NO: 4575 - DNA, 199 bp, Homo sapiens; identical to SEQ ID NO: 1350
  chr19:3785637-3785836
  hyper

SEQ ID NO: 4576 - DNA, 357 bp, Homo sapiens; identical to SEQ ID NO: 1351
  chr19:3785864-3786221
  hyper

SEQ ID NO: 4577 - DNA, 16 bp, Homo sapiens
  chr19:3786583-3786599
  hyper
gcgcggcggggaccgg

SEQ ID NO: 4578 - DNA, 141 bp, Homo sapiens; identical to SEQ ID NO: 1353
  chr19:6590370-6590511
  hyper

SEQ ID NO: 4579 - DNA, 118 bp, Homo sapiens; identical to SEQ ID NO: 1354
  chr19:9473938-9474056
  hyper

SEQ ID NO: 4580 - DNA, 40 bp, Homo sapiens
  chr19:9609379-9609419
  hyper
attctagtttccctccgcgtgggtgcggaggtatcaaggg

SEQ ID NO: 4581 - DNA, 7 bp, Homo sapiens
  chr19:10406153-10406160
  hyper
tcaacat

SEQ ID NO: 4582 - DNA, 133 bp, Homo sapiens
  chr19:10406278-10406411
  hyper
cgcgtggccggtaagtggcagctggggagaggcggggcgaggtatctgagagggggcgtgacctgggtcttggggcggccggccccgcctgcctccctctcggtcccggtagactagacggaagtgggacaga

SEQ ID NO: 4583 - DNA, 4 bp, Homo sapiens
  chr19:10624849-10624853
  hyper
gcgc

SEQ ID NO: 4584 - DNA, 443 bp, Homo sapiens; identical to SEQ ID NO: 1356
  chr19:10624965-10625408
  hyper

SEQ ID NO: 4585 - DNA, 154 bp, Homo sapiens
  chr19:11591031-11591185
  hyper
cccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctccc

SEQ ID NO: 4586 - DNA, 585 bp, Homo sapiens
  chr19:11592710-11593295
  hyper
gccggtgcatgtttacgtcggggcgcgggaactagcacacactggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcaccaggggatgctgccacgcctggaaagggcaggccaatcgcagtggcccgcgcaataggggcggtggcggtgcagatccccgggtggcccctcttgggctcgccggggcgacctggctgcgggcgctaggggccccaagcgatggtctgttccccaccccgtgttcctcccggtttccgtcatcggaaactgagctaggaggggggctgctcctgggcgcgcggaccccgctgcggttcccatggaaacctgccggctccggcagtgcggggag

SEQ ID NO: 4587 - DNA, 97 bp, Homo sapiens
  chr19:11959663-11959760
  hyper
tcgctctgtcacctgcgctatgccctgctttactcacaggagctgtagagaggaccccggtacatctgaaagccgggaaatggtgcgtgtgctggcc

SEQ ID NO: 4588 - DNA, 272 bp, Homo sapiens
  chr19:11959761-11960033
  hyper
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcg

SEQ ID NO: 4589 - DNA, 336 bp, Homo sapiens; identical to SEQ ID NO: 1357
  chr19:12203013-12203349
  hyper

SEQ ID NO: 4590 - DNA, 343 bp, Homo sapiens; identical to SEQ ID NO: 1358
  chr19:12203350-12203693
  hyper

SEQ ID NO: 4591 - DNA, 289 bp, Homo sapiens
  chr19:12267019-12267308
  hyper
cacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagcc

SEQ ID NO: 4592 - DNA, 342 bp, Homo sapiens
  chr19:12267309-12267651
  hyper
gttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgaca

SEQ ID NO: 4593 - DNA, 15 bp, Homo sapiens
  chr19:12306229-12306244
  hyper
cgtgtctccccagat

SEQ ID NO: 4594 - DNA, 261 bp, Homo sapiens; identical to SEQ ID NO: 1359
  chr19:13616696-13616957
  hyper

SEQ ID NO: 4595 - DNA, 307 bp, Homo sapiens; identical to SEQ ID NO: 1360
  chr19:13617158-13617465
  hyper

SEQ ID NO: 4596 - DNA, 29 bp, Homo sapiens
  chr19:13617489-13617518
  hyper
cggtttgcaaaggacgccccccccgggac

SEQ ID NO: 4597 - DNA, 173 bp, Homo sapiens
  chr19:14584240-14584413
  hyper
ggcccaccatctccacgtcgtgggcgcgagctctgcgtgccgagccgctgctccgagagccgccaaagaaggtggaggccgaagcgatggacgaggcggacgaggcggaggccgagcggggtccgtgcgccccccagcgacgccggctgtcggggcctgaggccgggggaggc

SEQ ID NO: 4598 - DNA, 26 bp, Homo sapiens
  chr19:14584536-14584562
  hyper
cgccagccgcccgggggacccaggcc

SEQ ID NO: 4599 - DNA, 477 bp, Homo sapiens
  chr19:15090075-15090552
  hyper
acgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggc

SEQ ID NO: 4600 - DNA, 138 bp, Homo sapiens; identical to SEQ ID NO: 1362
  chr19:17007251-17007389
  hyper

SEQ ID NO: 4601 - DNA, 347 bp, Homo sapiens; identical to SEQ ID NO: 1363
  chr19:17007446-17007793
  hyper

SEQ ID NO: 4602 - DNA, 44 bp, Homo sapiens
  chr19:17008475-17008519
  hyper
gggcggcagtggctccgcgcactcacccgggccccgggcagggg

SEQ ID NO: 4603 - DNA, 114 bp, Homo sapiens
  chr19:17008585-17008699
  hyper
cgttgtagaagcgagtggcctcgaaggctacgggacgagggtggcgggtgaccaagtgcaggcgcgacgggtcagggaccgggccgggccgggggtgcgggcgcgcgggcctac

SEQ ID NO: 4604 - DNA, 398 bp, Homo sapiens
  chr19:17501241-17501639
  hyper
ctctatacacgtccccgcagaccccccccccatatgtgtcctccaggccgacgcccccttccggcagggggccgactcaccctcgtgcgcgccgcgccggccgccggcagcccccggagggtccggagcgagagcgcgagcgagggctgggccggggtcgggaccccgagcggggacgcggccggggcactctgcgctgtgggctcatctcggcttccaggacgttactgccgggaagggggaagggggctgtcagcctctggacccctgtccccagacatcgccagccctcatccgccagagcgtccctttgctgggaactccatccccagagatccccatctcccagggtttcccgctccccaggatccggcatccgttctcgacccccagccatt

SEQ ID NO: 4605 - DNA, 606 bp, Homo sapiens
  chr19:18901603-18902209
  hyper
actgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaacagcctggatcccgggcctctcacgggtcctacagtccgttgtggggccgtgggcacggcgcgggtgctaacgcggcttacccaacgggctctggccctgtccggacgcgccgagggcagccagggtgagcagaagaacgcaggcggtgtcggggaccatggcggtggcggggagctgggtggctgctcgctttctaccgcccacgaggcccgcggggcctatttatccccaaggcacggccggccccagggacggcccaccacagccctgcccaacgtccagcctcaagg

SEQ ID NO: 4606 - DNA, 336 bp, Homo sapiens
  chr19:19651512-19651848
  hyper
cgtcaggaggcccagcgggtcaggacccatgtccggccccctggaacgcatctccctcccgctgccctcatttgagcatctgtaagagctcagttctgtggagtgtcttgagcccaaatgcgtgcaggatgcagggagaaaagcaggactgatccccgggaccttatgcgggggtggggaggtgggtcggtacctaaactatgtcttcgacaggcgcgcctaggggagcatgggtgggggcgatggcagatctgctctctggagtgtccgcccttggatgcacatatgtgagggggttggggaagaagggtcctttagtcccaggttacccggagg

SEQ ID NO: 4607 - DNA, 50 bp, Homo sapiens
  chr19:19651990-19652040
  hyper
cgctggggatgcgtgtcccgggcgtcctctggaggcgcagaagtgcgtgc

SEQ ID NO: 4608 - DNA, 300 bp, Homo sapiens
  chr19:22018420-22018720
  hyper
tgctgggattaaaggcgtgacccaccgcgcccggccgactctcctgtttctaatagaccaaaagagggactagaaatgccacggaccaaagctcttcctattcatgaaactgcatcacgagtcaggattctctcctgacgaccctcctgtggcccctgcacaatttgggagagacgccgcgttgcggctgcagagctgcccacagagggctgcaggccgggacacagtcactgcgcagagaagagacaggacgcccggggctgcctcccagagcagccgccatcttatggctgaagggga

SEQ ID NO: 4609 - DNA, 58 bp, Homo sapiens
  chr19:22018900-22018958
  hyper
cagagccacagaggctggacctctagcagcagaggacacagaagaacgaagacgagac

SEQ ID NO: 4610 - DNA, 61 bp, Homo sapiens
  chr19:22018959-22019020
  hyper
cagagctccaactgcagccagagacaaaggccccgccacatcccggaagccgccctgtcct

SEQ ID NO: 4611 - DNA, 28 bp, Homo sapiens
  chr19:22019080-22019108
  hyper
aaggtcctgcccccgcaaaccctgaatg

SEQ ID NO: 4612 - DNA, 39 bp, Homo sapiens
  chr19:22034379-22034418
  hyper
tgaagaccccagggccgcagctcctcctgcgcacacacc

SEQ ID NO: 4613 - DNA, 3 bp, Homo sapiens
  chr19:22034419-22034422
  hyper
agt

SEQ ID NO: 4614 - DNA, 592 bp, Homo sapiens
  chr19:22034446-22035038
  hyper
cgggcatccctgaacaatctgggaaatactcggggctgctggtgcagagctgaccagagagctccagacagggtaccgcgcaggaatggggcgggacgcgggaggctcggctgcgggcccagccgccatcttgcggccagaggggcctggggcggagctgcgccagcgaccaggactcaggagcggactgtgaggaggccggtcccgccactttcacagcctgctctcccctctcgggatgcctaaccccgcacactcaccatttcccagcttccaggatgtccgggcatcttagctgtgcgtctcccaggacttgcagatcacagggtaacggaggctgcgacaaagtcaccggggattcccgagttggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 4615 - DNA, 256 bp, Homo sapiens; identical to SEQ ID NO: 1364
  chr19:23257752-23258008
  hyper

SEQ ID NO: 4616 - DNA, 287 bp, Homo sapiens; identical to SEQ ID NO: 1365
  chr19:23258305-23258592
  hyper

SEQ ID NO: 4617 - DNA, 79 bp, Homo sapiens; identical to SEQ ID NO: 1366
  chr19:23258652-23258731
  hyper

SEQ ID NO: 4618 - DNA, 218 bp, Homo sapiens
  chr19:23299712-23299930
  hyper
cagggcctgagggggcggggccttaaacgttatccaatcggggacactgggcggggggccgtccaatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtatt

SEQ ID NO: 4619 - DNA, 391 bp, Homo sapiens; identical to SEQ ID NO: 1367
  chr19:30015572-30015963
  hyper

SEQ ID NO: 4620 - DNA, 724 bp, Homo sapiens; identical to SEQ ID NO: 1368
  chr19:30016024-30016748
  hyper

SEQ ID NO: 4621 - DNA, 59 bp, Homo sapiens; identical to SEQ ID NO: 1369
  chr19:30017451-30017510
  hyper

SEQ ID NO: 4622 - DNA, 145 bp, Homo sapiens; identical to SEQ ID NO: 1370
  chr19:30017577-30017722
  hyper

SEQ ID NO: 4623 - DNA, 967 bp, Homo sapiens; identical to SEQ ID NO: 1371
  chr19:30017765-30018732
  hyper

SEQ ID NO: 4624 - DNA, 416 bp, Homo sapiens; identical to SEQ ID NO: 1372
  chr19:30019113-30019529
  hyper

SEQ ID NO: 4625 - DNA, 81 bp, Homo sapiens; identical to SEQ ID NO: 1373
  chr19:30019530-30019611
  hyper

SEQ ID NO: 4626 - DNA, 252 bp, Homo sapiens; identical to SEQ ID NO: 1374
  chr19:30019660-30019912
  hyper

SEQ ID NO: 4627 - DNA, 153 bp, Homo sapiens
  chr19:30020190-30020343
  hyper
gttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaag

SEQ ID NO: 4628 - DNA, 135 bp, Homo sapiens
  chr19:30713458-30713593
  hyper
gaggcatgcagagggcgtcggcgccgacagggggagccggagagccccctgcccggccgtctgcggggctcaggcggggcttggcctccgatgagcgcgctgtctctgcccggtgggtcccaccccgcccggcca

SEQ ID NO: 4629 - DNA, 123 bp, Homo sapiens
  chr19:30713685-30713808
  hyper
cgaggccgcagaagccttgggcctccaggcctggaaggggctcccctggcctggaggccatgggcccggcccagaccggccagacaccgccagggacccccagaacgacgccaggacgcgcgc

SEQ ID NO: 4630 - DNA, 476 bp, Homo sapiens
  chr19:30715393-30715869
  hyper
agagaacctgcgtgacgtttttctcgaagtttaattaccgtatgctaatttccttgcctactacgtgattaattaaaatcatattttcataatcatttggcactagtattgttttagaattatcatgatctcctaaatagtgtctgtaaataaagtcgcctctaatggcaggcgcgggaggcgaggctgaggacctctccgcgtttgtatcgcggcgattggcaacataactgccttatttacattaaatacgccacaaggttacagcgcggatcaacgtcatttgatcgctgatgactcccttaaacgcccgggctgtgactgattcttcgcgtcccgctgtccaccgagattcacccgggagtttttttttttttttttttttttcctcccagaaaagaaacagactttaaatagtttcaggagcaggtaagaattacgctttttcctcgccccttctccgtctctctctcctc

SEQ ID NO: 4631 - DNA, 457 bp, Homo sapiens; identical to SEQ ID NO: 1375
  chr19:30716313-30716770
  hyper

SEQ ID NO: 4632 - DNA, 779 bp, Homo sapiens; identical to SEQ ID NO: 1376
  chr19:30716952-30717731
  hyper

SEQ ID NO: 4633 - DNA, 756 bp, Homo sapiens; identical to SEQ ID NO: 1377
  chr19:30719283-30720039
  hyper

SEQ ID NO: 4634 - DNA, 330 bp, Homo sapiens
  chr19:30865695-30866025
  hyper
gaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccc

SEQ ID NO: 4635 - DNA, 146 bp, Homo sapiens
  chr19:32715595-32715741
  hyper
taaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccg

SEQ ID NO: 4636 - DNA, 360 bp, Homo sapiens
  chr19:33166988-33167348
  hyper
cgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgc

SEQ ID NO: 4637 - DNA, 507 bp, Homo sapiens
  chr19:36048580-36049087
  hyper
ccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtg

SEQ ID NO: 4638 - DNA, 174 bp, Homo sapiens
  chr19:36450122-36450296
  hyper
gcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtgg

SEQ ID NO: 4639 - DNA, 15 bp, Homo sapiens
  chr19:36450544-36450559
  hyper
cgccccagggtcgct

SEQ ID NO: 4640 - DNA, 73 bp, Homo sapiens
  chr19:36523333-36523406
  hyper
gctggagagggtgcccggcaggctccagggtccaagcccctaggagcttccagggccccgggtggcctccgcg

SEQ ID NO: 4641 - DNA, 84 bp, Homo sapiens
  chr19:36736319-36736403
  hyper
cccacccagaaaatccggatcacatttcccgtggtccaccgcgcatctaggaggttacctgcgtccaggcggtgacttgcgagg

SEQ ID NO: 4642 - DNA, 225 bp, Homo sapiens
  chr19:36822242-36822467
  hyper
ataaacctcaacctgcgggtcactccctcccaggcgtgcaacaaaacacctgcctagaaatcaaaaggcgttttacccgagtgggctgaaaaagccccgtttttacctttaatctggagacaatacgggtcagaggtcaggaaactacatcagcgccagtgcgagcgcccacgagtccggtggacggatgagaaacggccggggggcagcctgagtcccagttcc

SEQ ID NO: 4643 - DNA, 146 bp, Homo sapiens
  chr19:36822557-36822703
  hyper
cgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgtta

SEQ ID NO: 4644 - DNA, 280 bp, Homo sapiens; identical to SEQ ID NO: 1378
  chr19:36909069-36909349
  hyper

SEQ ID NO: 4645 - DNA, 244 bp, Homo sapiens; identical to SEQ ID NO: 1379
  chr19:36909623-36909867
  hyper

SEQ ID NO: 4646 - DNA, 33 bp, Homo sapiens
  chr19:37096487-37096520
  hyper
gcgaagggggattttgcccgttctgatcccgcg

SEQ ID NO: 4647 - DNA, 171 bp, Homo sapiens; identical to SEQ ID NO: 1380
  chr19:37264222-37264393
  hyper

SEQ ID NO: 4648 - DNA, 25 bp, Homo sapiens
  chr19:37287936-37287961
  hyper
tttgttttttgaaaccgagtttcgc

SEQ ID NO: 4649 - DNA, 224 bp, Homo sapiens; identical to SEQ ID NO: 1382
  chr19:37288201-37288425
  hyper

SEQ ID NO: 4650 - DNA, 99 bp, Homo sapiens; identical to SEQ ID NO: 1383
  chr19:37288606-37288705
  hyper

SEQ ID NO: 4651 - DNA, 59 bp, Homo sapiens; identical to SEQ ID NO: 1384
  chr19:37288706-37288765
  hyper

SEQ ID NO: 4652 - DNA, 108 bp, Homo sapiens
  chr19:37406765-37406873
  hyper
ctccacctttcaggccgctccgcccgcaggggcccaaggcgccagctccccatcggtcttcggtatcctcacctaagccctttccagtcatcccggatgggaacttgc

SEQ ID NO: 4653 - DNA, 71 bp, Homo sapiens; identical to SEQ ID NO: 1385
  chr19:37407081-37407152
  hyper

SEQ ID NO: 4654 - DNA, 221 bp, Homo sapiens; identical to SEQ ID NO: 1386
  chr19:37407153-37407374
  hyper

SEQ ID NO: 4655 - DNA, 68 bp, Homo sapiens; identical to SEQ ID NO: 1387
  chr19:37407375-37407443
  hyper

SEQ ID NO: 4656 - DNA, 153 bp, Homo sapiens
  chr19:37997838-37997991
  hyper
ccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactac

SEQ ID NO: 4657 - DNA, 117 bp, Homo sapiens
  chr19:37997992-37998109
  hyper
gtggccgactgggtcagctatgggtgcccgtgagggtcaatgacaagggaactgaagggttaagagattcggcgtctgagcctcgcggggcctcagtggtggcggacagaggtttgc

SEQ ID NO: 4658 - DNA, 201 bp, Homo sapiens
  chr19:38042365-38042566
  hyper
tggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcga

SEQ ID NO: 4659 - DNA, 34 bp, Homo sapiens
  chr19:38183440-38183474
  hyper
cttttaaatacaccccgaacgtctatctctttta

SEQ ID NO: 4660 - DNA, 347 bp, Homo sapiens; identical to SEQ ID NO: 1388
  chr19:39754886-39755233
  hyper

SEQ ID NO: 4661 - DNA, 156 bp, Homo sapiens; identical to SEQ ID NO: 1389
  chr19:39755264-39755420
  hyper

SEQ ID NO: 4662 - DNA, 223 bp, Homo sapiens
  chr19:39993434-39993657
  hyper
tcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactg

SEQ ID NO: 4663 - DNA, 32 bp, Homo sapiens
  chr19:39997701-39997733
  hyper
cacgccctgcgctgccgctgccgcgccggctt

SEQ ID NO: 4664 - DNA, 238 bp, Homo sapiens
  chr19:39997748-39997986
  hyper
cgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttccca

SEQ ID NO: 4665 - DNA, 279 bp, Homo sapiens
  chr19:40724000-40724279
  hyper
cttcagctgcagcagcgctcggtggtacttgccgatggcctcccggaacttcttctctcgatagcagcgctggccctctgccttgaacgccacggcggcacgcaggctgctgtcgagcgccgcgcccaggctccccgacggctctggggtaggaccgggacgagccgagccatggcgggagcccgagcctgggcccgagcccggtggggagagggcgggaggcgggcgcggcggaggctccggggcagcgctgagcatcagcaccggggacagcgcgcc

SEQ ID NO: 4666 - DNA, 111 bp, Homo sapiens
  chr19:41073569-41073680
  hyper
tcgagaaaatcaaagcggaacagagcaagcagccgcctaccccactgctggggcgcaagttctttggggaccccacggaactggcggccaaggcggcgcccctgctgcggc

SEQ ID NO: 4667 - DNA, 616 bp, Homo sapiens; identical to SEQ ID NO: 1390
  chr19:45655778-45656394
  hyper

SEQ ID NO: 4668 - DNA, 61 bp, Homo sapiens
  chr19:45656682-45656743
  hyper
gccgacaatgccactcgctctggcagcagtcctgcctggtggccggcttgttgcccagcac

SEQ ID NO: 4669 - DNA, 166 bp, Homo sapiens
  chr19:45656790-45656956
  hyper
cgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagcc

SEQ ID NO: 4670 - DNA, 361 bp, Homo sapiens; identical to SEQ ID NO: 1391
  chr19:45888864-45889225
  hyper

SEQ ID NO: 4671 - DNA, 82 bp, Homo sapiens; identical to SEQ ID NO: 1392
  chr19:45889315-45889397
  hyper

SEQ ID NO: 4672 - DNA, 197 bp, Homo sapiens
  chr19:46916791-46916988
  hyper
gcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccc

SEQ ID NO: 4673 - DNA, 78 bp, Homo sapiens; identical to SEQ ID NO: 1393
  chr19:48918201-48918279
  hyper

SEQ ID NO: 4674 - DNA, 186 bp, Homo sapiens
  chr19:49925774-49925960
  hyper
ggcggcgctcgagggcggccagcaaccgcgcgcgctcccggaaggccgcgtcgtccgccagcgccaggctcctccgcggcctgggggtggcgggatccgcccaggcccgtcctggggggcggaggctgtggagagacgcggtgaccgcgcgtccagactcgctcttgccgccgcctgtcctccccg

SEQ ID NO: 4675 - DNA, 290 bp, Homo sapiens
  chr19:50554012-50554302
  hyper
cggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtg

SEQ ID NO: 4676 - DNA, 26 bp, Homo sapiens
  chr19:51162427-51162453
  hyper
gcaccgccccgcgggctggggccacc

SEQ ID NO: 4677 - DNA, 206 bp, Homo sapiens
  chr19:51227602-51227808
  hyper
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagc

SEQ ID NO: 4678 - DNA, 21 bp, Homo sapiens
  chr19:51228248-51228269
  hyper
gcctccttctctacccggccc

SEQ ID NO: 4679 - DNA, 271 bp, Homo sapiens
  chr19:51228368-51228639
  hyper
cgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactg

SEQ ID NO: 4680 - DNA, 91 bp, Homo sapiens
  chr19:51228702-51228793
  hyper
cgtctgcgagttccccttctagcggggccggtaccccgcctccctgcccatcccaccacccggcctttccctgcgccgtgcccaccctcct

SEQ ID NO: 4681 - DNA, 114 bp, Homo sapiens; identical to SEQ ID NO: 1394
  chr19:51830889-51831003
  hyper

SEQ ID NO: 4682 - DNA, 270 bp, Homo sapiens; identical to SEQ ID NO: 1395
  chr19:51831120-51831390
  hyper

SEQ ID NO: 4683 - DNA, 333 bp, Homo sapiens
  chr19:53073440-53073773
  hyper
ctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcc

SEQ ID NO: 4684 - DNA, 46 bp, Homo sapiens
  chr19:53073819-53073865
  hyper
cgtagtttctgtgctcaaaaccgttttttaactcctccctccccgc

SEQ ID NO: 4685 - DNA, 172 bp, Homo sapiens
  chr19:53073866-53074038
  hyper
cttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctccc

SEQ ID NO: 4686 - DNA, 482 bp, Homo sapiens
  chr19:53696167-53696649
  hyper
aggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcgacccccagagtctcgcggcaaagtctgaatttacatggaatggagggagccgtgcggggactttaagggctatacgaacccccggacatcgggtacggaggagcaggggactccgaaacgcaggtttaatctagatagagggaaactcacgcggcgactaacagccttcactccaagagatctgcttccgggtttgcaagaaactgcccgcgcagtaggcaaaggggcgggttgc

SEQ ID NO: 4687 - DNA, 13 bp, Homo sapiens
  chr19:53696650-53696663
  hyper
gtggggaaaggcc

SEQ ID NO: 4688 - DNA, 142 bp, Homo sapiens
  chr19:53970501-53970643
  hyper
gcatccctcccaccccggcgccccatccagcaggtggtcacctcactcctccctggcctgagcactccgtcccgcatccatggcggtggctttagggaaatctctgaagttgagcacggggtggacttgccctcctgagtga

SEQ ID NO: 4689 - DNA, 261 bp, Homo sapiens
  chr19:53970763-53971024
  hyper
aattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagt

SEQ ID NO: 4690 - DNA, 153 bp, Homo sapiens
  chr19:54412839-54412992
  hyper
gggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcct

SEQ ID NO: 4691 - DNA, 197 bp, Homo sapiens; identical to SEQ ID NO: 1396
  chr19:54481771-54481968
  hyper

SEQ ID NO: 4692 - DNA, 77 bp, Homo sapiens; identical to SEQ ID NO: 1397
  chr19:54483391-54483468
  hyper

SEQ ID NO: 4693 - DNA, 94 bp, Homo sapiens
  chr19:54485553-54485647
  hyper
caaggccggcgggggcgcgggcggcagtggcgggagcggcccctcggccatcctccgtctgcccagttaccgcttccgctaccgccgccgctcc

SEQ ID NO: 4694 - DNA, 325 bp, Homo sapiens
  chr19:54485672-54485997
  hyper
cgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcc

SEQ ID NO: 4695 - DNA, 131 bp, Homo sapiens
  chr19:56728658-56728789
  hyper
cgatgatgactccagctttctccttctaggcattccggttgggcatgaccggtcctgtcagccgagcggccagtttcagttcttcagcagaactgtctcccttctcggaggccgagggcttcccggggaag

SEQ ID NO: 4696 - DNA, 53 bp, Homo sapiens; identical to SEQ ID NO: 1398
  chr19:56879501-56879554
  hyper

SEQ ID NO: 4697 - DNA, 90 bp, Homo sapiens; identical to SEQ ID NO: 1399
  chr19:56879555-56879645
  hyper

SEQ ID NO: 4698 - DNA, 322 bp, Homo sapiens; identical to SEQ ID NO: 1400
  chr19:56879646-56879968
  hyper

SEQ ID NO: 4699 - DNA, 193 bp, Homo sapiens; identical to SEQ ID NO: 1401
  chr19:56904511-56904704
  hyper

SEQ ID NO: 4700 - DNA, 274 bp, Homo sapiens; identical to SEQ ID NO: 1402
  chr19:56904723-56904997
  hyper

SEQ ID NO: 4701 - DNA, 50 bp, Homo sapiens; identical to SEQ ID NO: 1403
  chr19:56904998-56905048
  hyper

SEQ ID NO: 4702 - DNA, 107 bp, Homo sapiens
  chr19:56988557-56988664
  hyper
gcgccttggcaggaacgtccacgcagtggcgggcgcgccgcccacgccctcagacacacccacactctcgccagcccccttacctcggtcttcccgggctcagaccc

SEQ ID NO: 4703 - DNA, 183 bp, Homo sapiens; identical to SEQ ID NO: 1404
  chr19:57182944-57183127
  hyper

SEQ ID NO: 4704 - DNA, 227 bp, Homo sapiens
  chr19:57617489-57617716
  hyper
ccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaagggg

SEQ ID NO: 4705 - DNA, 200 bp, Homo sapiens
  chr19:58038923-58039123
  hyper
cgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaa

SEQ ID NO: 4706 - DNA, 480 bp, Homo sapiens; identical to SEQ ID NO: 1405
  chr19:58094988-58095468
  hyper

SEQ ID NO: 4707 - DNA, 308 bp, Homo sapiens; identical to SEQ ID NO: 1406
  chr19:58095469-58095777
  hyper

SEQ ID NO: 4708 - DNA, 467 bp, Homo sapiens; identical to SEQ ID NO: 1407
  chr19:58219926-58220393
  hyper

SEQ ID NO: 4709 - DNA, 217 bp, Homo sapiens; identical to SEQ ID NO: 1408
  chr19:58220515-58220732
  hyper

SEQ ID NO: 4710 - DNA, 413 bp, Homo sapiens; identical to SEQ ID NO: 1409
  chr19:58238326-58238739
  hyper

SEQ ID NO: 4711 - DNA, 25 bp, Homo sapiens
  chr19:58238987-58239012
  hyper
gctacaaggaggagccggaagtccc

SEQ ID NO: 4712 - DNA, 188 bp, Homo sapiens; identical to SEQ ID NO: 1411
  chr19:58239013-58239201
  hyper

SEQ ID NO: 4713 - DNA, 112 bp, Homo sapiens; identical to SEQ ID NO: 1412
  chr19:58400406-58400518
  hyper

SEQ ID NO: 4714 - DNA, 28 bp, Homo sapiens
  chr19:58609498-58609526
  hyper
tcgctctctgacccccgcgctgcatccc

SEQ ID NO: 4715 - DNA, 32 bp, Homo sapiens
  chr19:58609712-58609744
  hyper
gcatggccaatcagacgcgagtgtggcctccc

SEQ ID NO: 4716 - DNA, 62 bp, Homo sapiens
  chr19:58609745-58609807
  hyper
gcgtcccgcccactccggcgcctgcgtcattttgggcaccatggcaacgaagtaaacaagcg

SEQ ID NO: 4717 - DNA, 74 bp, Homo sapiens; identical to SEQ ID NO: 1413
  chr19:58951525-58951599
  hyper

SEQ ID NO: 4718 - DNA, 178 bp, Homo sapiens; identical to SEQ ID NO: 1414
  chr19:58951600-58951778
  hyper

SEQ ID NO: 4719 - DNA, 279 bp, Homo sapiens; identical to SEQ ID NO: 1415
  chr19:58951779-58952058
  hyper

SEQ ID NO: 4720 - DNA, 28 bp, Homo sapiens
  chr20:291135-291163
  hyper
cgttgccatagaaaccggccgcacaggc

SEQ ID NO: 4721 - DNA, 153 bp, Homo sapiens; identical to SEQ ID NO: 1417
  chr20:291220-291373
  hyper

SEQ ID NO: 4722 - DNA, 274 bp, Homo sapiens; identical to SEQ ID NO: 1418
  chr20:644552-644826
  hyper

SEQ ID NO: 4723 - DNA, 320 bp, Homo sapiens; identical to SEQ ID NO: 1419
  chr20:644985-645305
  hyper

SEQ ID NO: 4724 - DNA, 72 bp, Homo sapiens
  chr20:982727-982799
  hyper
ccttgcttcttccttcggttcagggcgagcatgtccacggcgtgggcgacgagcaggagcaggcagagtggc

SEQ ID NO: 4725 - DNA, 253 bp, Homo sapiens
  chr20:982891-983144
  hyper
gggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgc

SEQ ID NO: 4726 - DNA, 698 bp, Homo sapiens
  chr20:1783608-1784306
  hyper
gccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccc

SEQ ID NO: 4727 - DNA, 219 bp, Homo sapiens; identical to SEQ ID NO: 1420
  chr20:2780903-2781122
  hyper

SEQ ID NO: 4728 - DNA, 589 bp, Homo sapiens; identical to SEQ ID NO: 1421
  chr20:2781123-2781712
  hyper

SEQ ID NO: 4729 - DNA, 152 bp, Homo sapiens; identical to SEQ ID NO: 1422
  chr20:3052540-3052692
  hyper

SEQ ID NO: 4730 - DNA, 380 bp, Homo sapiens; identical to SEQ ID NO: 1423
  chr20:3052693-3053073
  hyper

SEQ ID NO: 4731 - DNA, 107 bp, Homo sapiens
  chr20:3073285-3073392
  hyper
cggggacaatgactgcggccctggggtcccacagacgttccctttgctagacttaaggaagagctaggcctgtccgcgctcccagcccccacgcagccagacacccg

SEQ ID NO: 4732 - DNA, 295 bp, Homo sapiens
  chr20:3073560-3073855
  hyper
cgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaa

SEQ ID NO: 4733 - DNA, 164 bp, Homo sapiens
  chr20:3641773-3641937
  hyper
cggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccc

SEQ ID NO: 4734 - DNA, 198 bp, Homo sapiens
  chr20:5296850-5297048
  hyper
ctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 4735 - DNA, 194 bp, Homo sapiens
  chr20:5297225-5297419
  hyper
cggttttcacctcgaggacccggacttgcacttgcagagccgctgcgtgggggatgtccctcttttttcctcgccccggcgggctcctccggcgtgtcagggtctctgggttccagctggagttggcgctccggccccacagctctttccagcgtctcggacctgtgcgccccgccccgcgctggactccgccc

SEQ ID NO: 4736 - DNA, 277 bp, Homo sapiens
  chr20:8112335-8112612
  hyper
atgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagccca

SEQ ID NO: 4737 - DNA, 205 bp, Homo sapiens; identical to SEQ ID NO: 1424
  chr20:9489503-9489708
  hyper

SEQ ID NO: 4738 - DNA, 96 bp, Homo sapiens
  chr20:17206513-17206609
  hyper
tagctttgaaacagtcgtcctcatttcgttacatacagaacgttcgtgcttcctccctctcaggcaagaagcggagtccgtcgtcagcagttagca

SEQ ID NO: 4739 - DNA, 10 bp, Homo sapiens
  chr20:20346166-20346176
  hyper
gggtggtgaa

SEQ ID NO: 4740 - DNA, 377 bp, Homo sapiens; identical to SEQ ID NO: 1426
  chr20:20347333-20347710
  hyper

SEQ ID NO: 4741 - DNA, 486 bp, Homo sapiens; identical to SEQ ID NO: 1427
  chr20:20347736-20348222
  hyper

SEQ ID NO: 4742 - DNA, 26 bp, Homo sapiens
  chr20:20348257-20348283
  hyper
cggctccggctcgcggattgaaccct

SEQ ID NO: 4743 - DNA, 281 bp, Homo sapiens; identical to SEQ ID NO: 1429
  chr20:21080676-21080957
  hyper

SEQ ID NO: 4744 - DNA, 817 bp, Homo sapiens; identical to SEQ ID NO: 1430
  chr20:21081028-21081845
  hyper

SEQ ID NO: 4745 - DNA, 30 bp, Homo sapiens; identical to SEQ ID NO: 1431
  chr20:21082094-21082124
  hyper

SEQ ID NO: 4746 - DNA, 741 bp, Homo sapiens; identical to SEQ ID NO: 1432
  chr20:21082215-21082956
  hyper

SEQ ID NO: 4747 - DNA, 416 bp, Homo sapiens
  chr20:21083498-21083914
  hyper
cagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtg

SEQ ID NO: 4748 - DNA, 70 bp, Homo sapiens
  chr20:21084291-21084361
  hyper
gtttcccattatacccgatcttggcctaaatggtgttcggcagcggggcggagagcgaggggtgaaatca

SEQ ID NO: 4749 - DNA, 365 bp, Homo sapiens
  chr20:21085787-21086152
  hyper
caccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 4750 - DNA, 257 bp, Homo sapiens
  chr20:21086194-21086451
  hyper
cgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatcca

SEQ ID NO: 4751 - DNA, 170 bp, Homo sapiens; identical to SEQ ID NO: 1433
  chr20:21086917-21087087
  hyper

SEQ ID NO: 4752 - DNA, 15 bp, Homo sapiens
  chr20:21372178-21372193
  hyper
gatggtggcggcgcc

SEQ ID NO: 4753 - DNA, 200 bp, Homo sapiens; identical to SEQ ID NO: 1435
  chr20:21372294-21372494
  hyper

SEQ ID NO: 4754 - DNA, 130 bp, Homo sapiens; identical to SEQ ID NO: 1436
  chr20:21376207-21376337
  hyper

SEQ ID NO: 4755 - DNA, 32 bp, Homo sapiens; identical to SEQ ID NO: 1437
  chr20:21376702-21376734
  hyper

SEQ ID NO: 4756 - DNA, 253 bp, Homo sapiens; identical to SEQ ID NO: 1438
  chr20:21376876-21377129
  hyper

SEQ ID NO: 4757 - DNA, 168 bp, Homo sapiens; identical to SEQ ID NO: 1439
  chr20:21377473-21377641
  hyper

SEQ ID NO: 4758 - DNA, 837 bp, Homo sapiens; identical to SEQ ID NO: 1440
  chr20:21377737-21378574
  hyper

SEQ ID NO: 4759 - DNA, 701 bp, Homo sapiens
  chr20:21485959-21486660
  hyper
gtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccct

SEQ ID NO: 4760 - DNA, 132 bp, Homo sapiens
  chr20:21486785-21486917
  hyper
cggctgtggtctgtgcccaaacacgatggaaaccggggctgggacgggcggtggtacgcacgtggaggagaagaggcatggcgggaaaaccacagccgaacacaggtcgactcgcacctcccaggcacccgc

SEQ ID NO: 4761 - DNA, 627 bp, Homo sapiens
  chr20:21486954-21487581
  hyper
cgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagcctttaaaaatcagagtgcgagagaggagtgtgtgtgtgtgtgtgtgtgtgtgtgtgtgtgtgtgtctcggggcgttggtgaaagcaataaaactcagatcgcttccttggcgagatagcggcggctataatgcgccggggggatcaggggtttatttgcagatcctggataaaagatgatatatcgacacggtttagagtgtcactgcgcttggcctctcagggagccacaagtacatatttcctgaaataccgcccagcacagtatctaatccgcccgccacttaacaccgggaggggaacttc

SEQ ID NO: 4762 - DNA, 146 bp, Homo sapiens; identical to SEQ ID NO: 1441
  chr20:21489301-21489447
  hyper

SEQ ID NO: 4763 - DNA, 80 bp, Homo sapiens; identical to SEQ ID NO: 1442
  chr20:21489621-21489701
  hyper

SEQ ID NO: 4764 - DNA, 523 bp, Homo sapiens; identical to SEQ ID NO: 1443
  chr20:21490175-21490698
  hyper

SEQ ID NO: 4765 - DNA, 88 bp, Homo sapiens; identical to SEQ ID NO: 1444
  chr20:21491258-21491346
  hyper

SEQ ID NO: 4766 - DNA, 319 bp, Homo sapiens; identical to SEQ ID NO: 1445
  chr20:21492507-21492826
  hyper

SEQ ID NO: 4767 - DNA, 764 bp, Homo sapiens; identical to SEQ ID NO: 1446
  chr20:21493230-21493994
  hyper

SEQ ID NO: 4768 - DNA, 205 bp, Homo sapiens
  chr20:21494557-21494762
  hyper
acgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggc

SEQ ID NO: 4769 - DNA, 453 bp, Homo sapiens
  chr20:21496683-21497136
  hyper
cgctcccgttggaagcctttgtcccggctcggtttttgcatttatttcagtggcgaaataatacatgattgacgctctctttcaatgtgtcctaactgtttggaataaatctaaggttgttcctagttgtcatggcattcaacccttttcaatggactatctcttcattcatttctgaatccgtccacaatattaaggaaaccccttcatgtcgacgctccccgattcctctttctcctcctactttttcttttctcctttctccccctccttccccccttttttcccctggaagaattagaaacttgtttgaatcgtcttcctcgaacccattacttttcgtgctttttttttttttttgctcgctttccgtctctgtctttctcagcgccccccctcctccgccctttcacgtgggagctcgtcgctctgccccgtcggaggagggaagtt

SEQ ID NO: 4770 - DNA, 312 bp, Homo sapiens
  chr20:21497802-21498114
  hyper
gcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcg

SEQ ID NO: 4771 - DNA, 370 bp, Homo sapiens
  chr20:21498479-21498849
  hyper
ggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgct

SEQ ID NO: 4772 - DNA, 303 bp, Homo sapiens; identical to SEQ ID NO: 1447
  chr20:21501450-21501753
  hyper

SEQ ID NO: 4773 - DNA, 58 bp, Homo sapiens; identical to SEQ ID NO: 1448
  chr20:21502087-21502145
  hyper

SEQ ID NO: 4774 - DNA, 257 bp, Homo sapiens; identical to SEQ ID NO: 1449
  chr20:21502443-21502700
  hyper

SEQ ID NO: 4775 - DNA, 281 bp, Homo sapiens
  chr20:21503617-21503898
  hyper
ccccctgcccccaaacgcgcgggtagattccctccctcctgcgcccctctgagcaggagatctgggaccccaggtttctcctgaccctcgcccctcctccgtccccagcagtgccttggactccgcagctcctggcgagcccggactgctggttaacaaggtcgccatctataaattgctcggtcgctaagacgccataaaaccaaagggccagatgtggcacgttatttatgtgtgaaaccgcgtttacactagatacgcggatccaaggccgatagcac

SEQ ID NO: 4776 - DNA, 21 bp, Homo sapiens
  chr20:21503899-21503920
  hyper
acttcgcgggaggtcacagac

SEQ ID NO: 4777 - DNA, 57 bp, Homo sapiens; identical to SEQ ID NO: 1450
  chr20:21682399-21682456
  hyper

SEQ ID NO: 4778 - DNA, 455 bp, Homo sapiens
  chr20:21683317-21683772
  hyper
tttgactcccgctttcggcaaagagtttacctctctttcttttcctgccttgggaaaactgggcgagggcccgaagcctctggggtaccctcagatccatcctctgccctgctaggagtccagccccaggcggaggagttttgccccaggtttctgagtgcgccctcagctaacaggctcccgcgaccctggaagcggaactttgttgcactccgcttccagaggacgctgaaatacggtgccaaacccagccaagcaaaaacgcagaatccgcgagctctttacctctgtgcgctcagcgctgactagtagctgtccccgggccatggagagggctaagctgcctccttgggaggtgggagagacgtttcttttccttctgcaatctcatcttagggccatctctcaccaagcctagcctgcagctcgggaacccgcgatacccggccggggga

SEQ ID NO: 4779 - DNA, 17 bp, Homo sapiens
  chr20:21683899-21683916
  hyper
cgcggactctgctaccg

SEQ ID NO: 4780 - DNA, 109 bp, Homo sapiens
  chr20:21686184-21686293
  hyper
ggtagagtttcagggcggggaggggggcgctggggcgcagtgacgggaaccaatgagctgccaactcgcgcgtctccggcgtgactgccgagattgacgtggaggacac

SEQ ID NO: 4781 - DNA, 369 bp, Homo sapiens
  chr20:21686294-21686663
  hyper
tcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctc

SEQ ID NO: 4782 - DNA, 61 bp, Homo sapiens
  chr20:21694499-21694560
  hyper
cacaacgtagtctgccgctcacttaaagcgcaactgcctcctacgtcggaggaatccaggc

SEQ ID NO: 4783 - DNA, 804 bp, Homo sapiens
  chr20:24449900-24450704
  hyper
gttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 4784 - DNA, 200 bp, Homo sapiens
  chr20:24450819-24451019
  hyper
cgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactc

SEQ ID NO: 4785 - DNA, 43 bp, Homo sapiens; identical to SEQ ID NO: 1451
  chr20:25061746-25061789
  hyper

SEQ ID NO: 4786 - DNA, 334 bp, Homo sapiens; identical to SEQ ID NO: 1452
  chr20:25061978-25062312
  hyper

SEQ ID NO: 4787 - DNA, 136 bp, Homo sapiens; identical to SEQ ID NO: 1453
  chr20:25062510-25062646
  hyper

SEQ ID NO: 4788 - DNA, 111 bp, Homo sapiens; identical to SEQ ID NO: 1454
  chr20:25062707-25062818
  hyper

SEQ ID NO: 4789 - DNA, 71 bp, Homo sapiens; identical to SEQ ID NO: 1455
  chr20:25062870-25062941
  hyper

SEQ ID NO: 4790 - DNA, 180 bp, Homo sapiens; identical to SEQ ID NO: 1456
  chr20:25063727-25063907
  hyper

SEQ ID NO: 4791 - DNA, 518 bp, Homo sapiens; identical to SEQ ID NO: 1457
  chr20:25063993-25064511
  hyper

SEQ ID NO: 4792 - DNA, 28 bp, Homo sapiens
  chr20:25065179-25065207
  hyper
ccacccagagcccagcgtcaagttatac

SEQ ID NO: 4793 - DNA, 187 bp, Homo sapiens; identical to SEQ ID NO: 1459
  chr20:25065208-25065395
  hyper

SEQ ID NO: 4794 - DNA, 24 bp, Homo sapiens
  chr20:34188608-34188632
  hyper
ttctttttcttctttcgggtgagc

SEQ ID NO: 4795 - DNA, 342 bp, Homo sapiens; identical to SEQ ID NO: 1461
  chr20:34188747-34189089
  hyper

SEQ ID NO: 4796 - DNA, 326 bp, Homo sapiens; identical to SEQ ID NO: 1462
  chr20:34189166-34189492
  hyper

SEQ ID NO: 4797 - DNA, 375 bp, Homo sapiens; identical to SEQ ID NO: 1463
  chr20:34189679-34190054
  hyper

SEQ ID NO: 4798 - DNA, 796 bp, Homo sapiens; identical to SEQ ID NO: 1464
  chr20:37302580-37303376
  hyper

SEQ ID NO: 4799 - DNA, 401 bp, Homo sapiens; identical to SEQ ID NO: 1465
  chr20:37352115-37352516
  hyper

SEQ ID NO: 4800 - DNA, 20 bp, Homo sapiens
  chr20:37352606-37352626
  hyper
cggggcgcccagaccagtcc

SEQ ID NO: 4801 - DNA, 284 bp, Homo sapiens; identical to SEQ ID NO: 1467
  chr20:37353435-37353719
  hyper

SEQ ID NO: 4802 - DNA, 1026 bp, Homo sapiens; identical to SEQ ID NO: 1468
  chr20:37353806-37354832
  hyper

SEQ ID NO: 4803 - DNA, 239 bp, Homo sapiens; identical to SEQ ID NO: 1469
  chr20:37354993-37355232
  hyper

SEQ ID NO: 4804 - DNA, 541 bp, Homo sapiens; identical to SEQ ID NO: 1470
  chr20:37355502-37356043
  hyper

SEQ ID NO: 4805 - DNA, 297 bp, Homo sapiens; identical to SEQ ID NO: 1471
  chr20:37356168-37356465
  hyper

SEQ ID NO: 4806 - DNA, 365 bp, Homo sapiens; identical to SEQ ID NO: 1472
  chr20:37357825-37358190
  hyper

SEQ ID NO: 4807 - DNA, 224 bp, Homo sapiens; identical to SEQ ID NO: 1473
  chr20:37434129-37434353
  hyper

SEQ ID NO: 4808 - DNA, 234 bp, Homo sapiens; identical to SEQ ID NO: 1474
  chr20:37434488-37434722
  hyper

SEQ ID NO: 4809 - DNA, 158 bp, Homo sapiens; identical to SEQ ID NO: 1475
  chr20:37434736-37434894
  hyper

SEQ ID NO: 4810 - DNA, 440 bp, Homo sapiens; identical to SEQ ID NO: 1476
  chr20:37434930-37435370
  hyper

SEQ ID NO: 4811 - DNA, 229 bp, Homo sapiens; identical to SEQ ID NO: 1477
  chr20:37435487-37435716
  hyper

SEQ ID NO: 4812 - DNA, 132 bp, Homo sapiens; identical to SEQ ID NO: 1478
  chr20:37435717-37435849
  hyper

SEQ ID NO: 4813 - DNA, 146 bp, Homo sapiens
  chr20:39319058-39319204
  hyper
gccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccc

SEQ ID NO: 4814 - DNA, 512 bp, Homo sapiens
  chr20:39995034-39995546
  hyper
gcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctc

SEQ ID NO: 4815 - DNA, 67 bp, Homo sapiens
  chr20:39995547-39995614
  hyper
ccgccgccagcccctcgccccagctccgagcggacggccgaggagccgcctgcgaacaggaggttcc

SEQ ID NO: 4816 - DNA, 236 bp, Homo sapiens; identical to SEQ ID NO: 1479
  chr20:41818513-41818749
  hyper

SEQ ID NO: 4817 - DNA, 211 bp, Homo sapiens; identical to SEQ ID NO: 1480
  chr20:41818804-41819015
  hyper

SEQ ID NO: 4818 - DNA, 836 bp, Homo sapiens; identical to SEQ ID NO: 1481
  chr20:42543698-42544534
  hyper

SEQ ID NO: 4819 - DNA, 257 bp, Homo sapiens; identical to SEQ ID NO: 1482
  chr20:42544727-42544984
  hyper

SEQ ID NO: 4820 - DNA, 128 bp, Homo sapiens; identical to SEQ ID NO: 1483
  chr20:45279854-45279982
  hyper

SEQ ID NO: 4821 - DNA, 218 bp, Homo sapiens; identical to SEQ ID NO: 1484
  chr20:45280039-45280257
  hyper

SEQ ID NO: 4822 - DNA, 218 bp, Homo sapiens
  chr20:47443719-47443937
  hyper
atcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcg

SEQ ID NO: 4823 - DNA, 297 bp, Homo sapiens
  chr20:47443944-47444241
  hyper
cggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggac

SEQ ID NO: 4824 - DNA, 186 bp, Homo sapiens
  chr20:47444242-47444428
  hyper
cagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttc

SEQ ID NO: 4825 - DNA, 129 bp, Homo sapiens
  chr20:47444452-47444581
  hyper
cgtccaggcgccccatcccggacggggcgcgccggcgggccgggctcagcggcgggccgggctcccggcgcggcgggcgggactgggggccgggcggctgggccgggggcggaggcagcgcgcgggggc

SEQ ID NO: 4826 - DNA, 184 bp, Homo sapiens
  chr20:47444609-47444793
  hyper
cggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagc

SEQ ID NO: 4827 - DNA, 295 bp, Homo sapiens
  chr20:47444920-47445215
  hyper
cgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccat

SEQ ID NO: 4828 - DNA, 134 bp, Homo sapiens
  chr20:47934853-47934987
  hyper
tacctagcttgagcccgaccatgggcatgcgtggcgtggcgcgaatcctgtccctgtcgctcgtcctggccgcggtggccacgggggcctgggagcgggggccgctgggcgtgctcttgccctggcagggctcc

SEQ ID NO: 4829 - DNA, 606 bp, Homo sapiens
  chr20:47934988-47935594
  hyper
ccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaagga

SEQ ID NO: 4830 - DNA, 809 bp, Homo sapiens; identical to SEQ ID NO: 1485
  chr20:50720392-50721201
  hyper

SEQ ID NO: 4831 - DNA, 437 bp, Homo sapiens; identical to SEQ ID NO: 1486
  chr20:50721234-50721671
  hyper

SEQ ID NO: 4832 - DNA, 218 bp, Homo sapiens
  chr20:54578507-54578725
  hyper
acatttatcctgttccgcaaaggtacccagggagcagcctcagcggcacccgcagaggagtctgagcaagggcaccaagatctggccaagagataacgacgtccagggaccaggtgcccttcggctcccgccgacctgttgctcgaaacttgccctgagctctcgctgccgggctctgggctcccaagcctctcccccgccgccgcagcagcctcttt

SEQ ID NO: 4833 - DNA, 413 bp, Homo sapiens; identical to SEQ ID NO: 1487
  chr20:55199898-55200311
  hyper

SEQ ID NO: 4834 - DNA, 98 bp, Homo sapiens; identical to SEQ ID NO: 1488
  chr20:55200615-55200713
  hyper

SEQ ID NO: 4835 - DNA, 320 bp, Homo sapiens
  chr20:55201037-55201357
  hyper
taaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 4836 - DNA, 2 bp, Homo sapiens
  chr20:55201450-55201452
  hyper
gg

SEQ ID NO: 4837 - DNA, 305 bp, Homo sapiens
  chr20:55201764-55202069
  hyper
aggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtg

SEQ ID NO: 4838 - DNA, 268 bp, Homo sapiens
  chr20:55202358-55202626
  hyper
gggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggaccca

SEQ ID NO: 4839 - DNA, 754 bp, Homo sapiens
  chr20:56803371-56804125
  hyper
cggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 4840 - DNA, 264 bp, Homo sapiens; identical to SEQ ID NO: 1489
  chr20:57224816-57225080
  hyper

SEQ ID NO: 4841 - DNA, 177 bp, Homo sapiens; identical to SEQ ID NO: 1490
  chr20:57225218-57225395
  hyper

SEQ ID NO: 4842 - DNA, 16 bp, Homo sapiens
  chr20:59826962-59826978
  hyper
agtgcacactcccacc

SEQ ID NO: 4843 - DNA, 68 bp, Homo sapiens
  chr20:59828340-59828408
  hyper
cgggagggcgagcgggtctcccgctgcctctgcagagccccgcgggccggattgccagctttgctctg

SEQ ID NO: 4844 - DNA, 374 bp, Homo sapiens
  chr20:61340304-61340678
  hyper
cagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcggg

SEQ ID NO: 4845 - DNA, 226 bp, Homo sapiens
  chr20:61560696-61560922
  hyper
ggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccaggg

SEQ ID NO: 4846 - DNA, 29 bp, Homo sapiens
  chr20:61637928-61637957
  hyper
ggggaggtcgccgcccgggcccggagtgc

SEQ ID NO: 4847 - DNA, 250 bp, Homo sapiens; identical to SEQ ID NO: 1492
  chr20:61638220-61638470
  hyper

SEQ ID NO: 4848 - DNA, 118 bp, Homo sapiens; identical to SEQ ID NO: 1493
  chr20:61638534-61638652
  hyper

SEQ ID NO: 4849 - DNA, 53 bp, Homo sapiens; identical to SEQ ID NO: 1494
  chr20:61703709-61703762
  hyper

SEQ ID NO: 4850 - DNA, 190 bp, Homo sapiens; identical to SEQ ID NO: 1495
  chr20:61703845-61704035
  hyper

SEQ ID NO: 4851 - DNA, 200 bp, Homo sapiens; identical to SEQ ID NO: 1496
  chr20:61808181-61808381
  hyper

SEQ ID NO: 4852 - DNA, 222 bp, Homo sapiens; identical to SEQ ID NO: 1497
  chr20:61808666-61808888
  hyper

SEQ ID NO: 4853 - DNA, 117 bp, Homo sapiens; identical to SEQ ID NO: 1498
  chr20:61808889-61809006
  hyper

SEQ ID NO: 4854 - DNA, 339 bp, Homo sapiens; identical to SEQ ID NO: 1499
  chr20:61809218-61809557
  hyper

SEQ ID NO: 4855 - DNA, 74 bp, Homo sapiens; identical to SEQ ID NO: 1500
  chr20:61809558-61809632
  hyper

SEQ ID NO: 4856 - DNA, 295 bp, Homo sapiens; identical to SEQ ID NO: 1501
  chr20:61809840-61810135
  hyper

SEQ ID NO: 4857 - DNA, 265 bp, Homo sapiens
  chr20:61884691-61884956
  hyper
cctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagct

SEQ ID NO: 4858 - DNA, 362 bp, Homo sapiens
  chr21:27012346-27012708
  hyper
gaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaa

SEQ ID NO: 4859 - DNA, 15 bp, Homo sapiens
  chr21:28340034-28340049
  hyper
ctcttgatgctttga

SEQ ID NO: 4860 - DNA, 286 bp, Homo sapiens
  chr21:28340062-28340348
  hyper
cgggctccgggtgactaacttctcccggccaccagcagagcggctggacagccagagagcccagggcgcttcctggcgcgctgcggtaccccggggcgagaacgcccgccgcttgggaactccgcagctttgtgtgcgaacggcgggctcccagctttctccagcacgcctttcgtcagggtccacaatctgtcccttactcccagcccactggaacttcctttgctctaaaaaggcagagcgagaaagagttaactcttagagggaattccgctcattttttttc

SEQ ID NO: 4861 - DNA, 221 bp, Homo sapiens
  chr21:31311413-31311634
  hyper
gggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacc

SEQ ID NO: 4862 - DNA, 102 bp, Homo sapiens
  chr21:31312079-31312181
  hyper
cggaggatcagcgctctctggctcccggagcccagagaccagctgaggaaagttgctgccccgatctgcaggaacgtctccctcattcgtcctttggtcaga

SEQ ID NO: 4863 - DNA, 638 bp, Homo sapiens; identical to SEQ ID NO: 1502
  chr21:34392436-34393074
  hyper

SEQ ID NO: 4864 - DNA, 337 bp, Homo sapiens
  chr21:34395421-34395758
  hyper
gaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccaggg

SEQ ID NO: 4865 - DNA, 696 bp, Homo sapiens; identical to SEQ ID NO: 1503
  chr21:34396045-34396741
  hyper

SEQ ID NO: 4866 - DNA, 93 bp, Homo sapiens; identical to SEQ ID NO: 1504
  chr21:34399166-34399259
  hyper

SEQ ID NO: 4867 - DNA, 664 bp, Homo sapiens; identical to SEQ ID NO: 1505
  chr21:34399441-34400105
  hyper

SEQ ID NO: 4868 - DNA, 27 bp, Homo sapiens
  chr21:34400231-34400258
  hyper
cgcgaggaggggcgcaggaccatggac

SEQ ID NO: 4869 - DNA, 225 bp, Homo sapiens
  chr21:34401167-34401392
  hyper
taagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatc

SEQ ID NO: 4870 - DNA, 382 bp, Homo sapiens; identical to SEQ ID NO: 1507
  chr21:34443981-34444363
  hyper

SEQ ID NO: 4871 - DNA, 154 bp, Homo sapiens; identical to SEQ ID NO: 1508
  chr21:34444444-34444598
  hyper

SEQ ID NO: 4872 - DNA, 96 bp, Homo sapiens; identical to SEQ ID NO: 1509
  chr21:36041933-36042029
  hyper

SEQ ID NO: 4873 - DNA, 79 bp, Homo sapiens; identical to SEQ ID NO: 1510
  chr21:36042091-36042170
  hyper

SEQ ID NO: 4874 - DNA, 144 bp, Homo sapiens; identical to SEQ ID NO: 1511
  chr21:36042171-36042315
  hyper

SEQ ID NO: 4875 - DNA, 522 bp, Homo sapiens
  chr21:36042632-36043154
  hyper
ggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 4876 - DNA, 519 bp, Homo sapiens
  chr21:38065004-38065523
  hyper
accttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttc

SEQ ID NO: 4877 - DNA, 262 bp, Homo sapiens
  chr21:38065799-38066061
  hyper
cggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgacccggagcagctctaggccgtgggcttcgtctcctcctcctggaaggaatgaatgggctccccgacacacacctctcagaaaactcacctttcacgctgaccttcaaaa

SEQ ID NO: 4878 - DNA, 131 bp, Homo sapiens
  chr21:38079932-38080063
  hyper
aagggtttgcgaagccgctgccctgggccgaggtgcattttacgcttccagaggtcgaggcctccagagaccgcgatgcccagggcgttcccggggaggctgagagacccagggtgctctgggtgactgca

SEQ ID NO: 4879 - DNA, 213 bp, Homo sapiens
  chr21:38080174-38080387
  hyper
cgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctc

SEQ ID NO: 4880 - DNA, 134 bp, Homo sapiens
  chr21:38080550-38080684
  hyper
ggctttcctgcttcctcggactgtgcaggggaagcctggggtctcgcggggcgcagcagtcaggtcgagggtgcagcaggaggggagtcctgacgggcaggtccctctttcccctggtgcgcaacactggttgg

SEQ ID NO: 4881 - DNA, 160 bp, Homo sapiens
  chr21:39286695-39286855
  hyper
gaggaaccaccacctcggcggcccccaggcaactttcgggaggtttcaggggcacccggccagctctgggcgccctctcgagcgtcgccgtcagggagttgggcacaaccgatgccctgggacccgccacagggcacgcggctggcgtattcctttgcct

SEQ ID NO: 4882 - DNA, 38 bp, Homo sapiens; identical to SEQ ID NO: 1512
  chr21:44494740-44494778
  hyper

SEQ ID NO: 4883 - DNA, 57 bp, Homo sapiens; identical to SEQ ID NO: 1513
  chr21:44494940-44494997
  hyper

SEQ ID NO: 4884 - DNA, 122 bp, Homo sapiens; identical to SEQ ID NO: 1514
  chr21:44494998-44495120
  hyper

SEQ ID NO: 4885 - DNA, 48 bp, Homo sapiens
  chr21:46126380-46126428
  hyper
cacacacccacgcgtacacacccacgcgcacacaccgctgtccccagc

SEQ ID NO: 4886 - DNA, 132 bp, Homo sapiens
  chr21:46126566-46126698
  hyper
cgagcagctccgggcctcaggggtcgccccgccaccgttttcctttcccagatgctgggacgggggcagggaggggctccccaggctgaacccgactaggtcaccctagaagcgaggcgagcttctcttctg

SEQ ID NO: 4887 - DNA, 107 bp, Homo sapiens
  chr21:46128961-46129068
  hyper
ggaaagagacgtggccgccctcgcatcctgcagctcccgcactcccagcctcccagcctcccacccagccccccagagcccaccagtgaccccgcccactgggtcct

SEQ ID NO: 4888 - DNA, 73 bp, Homo sapiens; identical to SEQ ID NO: 1515
  chr21:47010408-47010481
  hyper

SEQ ID NO: 4889 - DNA, 73 bp, Homo sapiens
  chr21:47062752-47062825
  hyper
gggcgctgcggccccagcctccgggccggggccaggcccacagagaacgggaagcgggcgctgcagggggacc

SEQ ID NO: 4890 - DNA, 839 bp, Homo sapiens
  chr21:47063538-47064377
  hyper
gccggcggcggcgcgcggcgctagattggttagcggcgcagaggggcgggcccgcgccgcgcgcagcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgt

SEQ ID NO: 4891 - DNA, 167 bp, Homo sapiens
  chr22:17600967-17601134
  hyper
cgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccgg

SEQ ID NO: 4892 - DNA, 143 bp, Homo sapiens
  chr22:17601259-17601402
  hyper
cgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcac

SEQ ID NO: 4893 - DNA, 303 bp, Homo sapiens
  chr22:17850318-17850621
  hyper
ggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttcca

SEQ ID NO: 4894 - DNA, 53 bp, Homo sapiens
  chr22:17850978-17851031
  hyper
gcctccccagccccacggatcttactttgtgccattttcgggttgattttaac

SEQ ID NO: 4895 - DNA, 15 bp, Homo sapiens
  chr22:19510932-19510947
  hyper
ggagaaggtcagctg

SEQ ID NO: 4896 - DNA, 315 bp, Homo sapiens; identical to SEQ ID NO: 1517
  chr22:19511141-19511456
  hyper

SEQ ID NO: 4897 - DNA, 335 bp, Homo sapiens; identical to SEQ ID NO: 1518
  chr22:19511541-19511876
  hyper

SEQ ID NO: 4898 - DNA, 67 bp, Homo sapiens; identical to SEQ ID NO: 1519
  chr22:19512252-19512319
  hyper

SEQ ID NO: 4899 - DNA, 15 bp, Homo sapiens
  chr22:19512376-19512391
  hyper
cgtagaggccctcgt

SEQ ID NO: 4900 - DNA, 127 bp, Homo sapiens
  chr22:19706238-19706365
  hyper
cgggcctgggggggtcgccgcgatggactcgctggcagcgccccaggaccgcctggtggagcagctgctgtcgccgcggacccaggcccagaggcggctcaaggtgcgtgtgtggagagggcggaac

SEQ ID NO: 4901 - DNA, 204 bp, Homo sapiens
  chr22:19706366-19706570
  hyper
tgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctcca

SEQ ID NO: 4902 - DNA, 166 bp, Homo sapiens
  chr22:22862697-22862863
  hyper
ggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctc

SEQ ID NO: 4903 - DNA, 88 bp, Homo sapiens
  chr22:22863219-22863307
  hyper
ggggttaaattgagaaggaggagggcagcagcaatacccctgaggccttgaaaggatcttgggttccggatcacggttccaggcagtc

SEQ ID NO: 4904 - DNA, 258 bp, Homo sapiens
  chr22:25678357-25678615
  hyper
tagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggcc

SEQ ID NO: 4905 - DNA, 253 bp, Homo sapiens
  chr22:25678616-25678869
  hyper
ctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcctgcggcgcttgcagggcgctggtggggcgcgccgagcaggggctgccctggggctgccccagtcccaccaggtcggggctcagctggcggcggcggcggcggtggcggcagcgcgtcccatc

SEQ ID NO: 4906 - DNA, 208 bp, Homo sapiens
  chr22:25679042-25679250
  hyper
cgctggtccccacgccgccgtccccaagcggccgtcagcgacctcctgcgtccgggagggtcgggcattgagtcgtcgctgtcctgggtgcgggtgacaccgcggaactggcgatgcggggccggcctccccgttccagtctctgaaatggggcatcggatggccggtgggggggactccgggagagagcgctccaaagtgcccagcg

SEQ ID NO: 4907 - DNA, 198 bp, Homo sapiens
  chr22:25679267-25679465
  hyper
cgagcgccccagggaggggctggttatgacttggctggaccagctccatccctgtcgccccctccccccggccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 4908 - DNA, 198 bp, Homo sapiens; identical to SEQ ID NO: 1521
  chr22:33453877-33454075
  hyper

SEQ ID NO: 4909 - DNA, 66 bp, Homo sapiens; identical to SEQ ID NO: 1522
  chr22:33454193-33454259
  hyper

SEQ ID NO: 4910 - DNA, 90 bp, Homo sapiens; identical to SEQ ID NO: 1523
  chr22:33454345-33454435
  hyper

SEQ ID NO: 4911 - DNA, 324 bp, Homo sapiens
  chr22:38220648-38220972
  hyper
cgcagggcccgggcgcgggacgtggcgcgggcccctgcgggagggcacctgcccgccccgctgaccaggcgccctccgcaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgag

SEQ ID NO: 4912 - DNA, 33 bp, Homo sapiens
  chr22:38477099-38477132
  hyper
cagacgcgccaggcccgccagggcgccgcacgc

SEQ ID NO: 4913 - DNA, 498 bp, Homo sapiens
  chr22:38477296-38477794
  hyper
cggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccga

SEQ ID NO: 4914 - DNA, 409 bp, Homo sapiens
  chr22:42310042-42310451
  hyper
tgctgggagaaccagcgcttcgagagcggcgggaaggatcagcgggcagggagagcagtccgaggagcaggcgggggtccctgggcggcgcgtgctcacctggtcactgtgcgccgcgcgcgcgggctgtgcgccctctccagtcccaggcgcgccccgatgccggccagcaccagcagcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttga

SEQ ID NO: 4915 - DNA, 369 bp, Homo sapiens
  chr22:42353611-42353980
  hyper
ctccctctgggtgggcgggacagggagcacctctgctggccctcaccacgctgtgtctccgcagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaagg

SEQ ID NO: 4916 - DNA, 234 bp, Homo sapiens
  chr22:44258285-44258519
  hyper
cgccgcctcccggctcgcagcccgcacgcgcccgcgcccgcgcccgcgcccgcgccccgcacacgctcgcgccccaccggcgcgcggcggcagctccgcaggcgtgacgtcatggcgccgccgacgcgcggcggaggctccgcgggtatgacgtcatggcgccgcccggcacgcggccgcggcgctgcacgggcgtgacgtcatggcgccgcggagccgcgtcctccccgcccc

SEQ ID NO: 4917 - DNA, 442 bp, Homo sapiens
  chr22:46262610-46263052
  hyper
gccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaagg

SEQ ID NO: 4918 - DNA, 309 bp, Homo sapiens
  chr22:48885529-48885838
  hyper
ggccccggccccggcacggccctctgggccccggaccccctcctccggccccggcaggcgccccgcgggcctcccggagtcggcgcggagttacgagcgccgggcgcatggtcccccgagtcccggccggtccaacgctgcgctgggcgggcgagagggtccacccgggttccgggcgctcgagcacttcggggtcggacgccccggcccgagcctcccttccctgactccccggcagggcccgggctccaggccccgggtggcgcggcccgtccctgcccggcggtcggagcccagccagcggcttcc

SEQ ID NO: 4919 - DNA, 148 bp, Homo sapiens; identical to SEQ ID NO: 1524
  chr22:48971532-48971680
  hyper

SEQ ID NO: 4920 - DNA, 201 bp, Homo sapiens; identical to SEQ ID NO: 1525
  chr22:48971758-48971959
  hyper

SEQ ID NO: 4921 - DNA, 176 bp, Homo sapiens; identical to SEQ ID NO: 1526
  chr22:48971960-48972136
  hyper

SEQ ID NO: 4922 - DNA, 212 bp, Homo sapiens
  chr22:50496971-50497183
  hyper
cgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcggggtgaggaggccgcgggcgctgggctcctcccgggctg

SEQ ID NO: 4923 - DNA, 74 bp, Homo sapiens
  chr22:50497213-50497287
  hyper
cggggtgaccgtatcagcgccccccgtcctgcggcggaacttgggagggccttggtatccgcagaaccactcgt

SEQ ID NO: 4924 - DNA, 59 bp, Homo sapiens
  chr22:50623656-50623715
  hyper
ctgagcgtccgggtccgtgaggccgggggtcggcccgccctaagactcccacctggtcc

SEQ ID NO: 4925 - DNA, 120 bp, Homo sapiens
  chr22:50623741-50623861
  hyper
cggggcccctggggcccgaccttcccggggtgccccaacctgcggcaaggccgaggtcccgctgaggcatgagtcccgggtcggggaccgctctgggccgacccccggaggacggactag

SEQ ID NO: 4926 - DNA, 88 bp, Homo sapiens; identical to SEQ ID NO: 1527
  chr22:51042317-51042405
  hyper

SEQ ID NO: 4927 - DNA, 109 bp, Homo sapiens; identical to SEQ ID NO: 1528
  chr22:51042457-51042566
  hyper

SEQ ID NO: 4928 - DNA, 420 bp, Homo sapiens; identical to SEQ ID NO: 1529
  AC241851.2_88-34049:15130-15550
  hyper

SEQ ID NO: 4929 - DNA, 36 bp, Homo sapiens
  JH636052.4:1362180-1362216
  hyper
acgccctatcggtgatgtcaccgacagtgcctttcc

SEQ ID NO: 4930 - DNA, 146 bp, Homo sapiens; identical to SEQ ID NO: 1530
  chr1:1235932-1236078
  hypo

SEQ ID NO: 4931 - DNA, 692 bp, Homo sapiens; identical to SEQ ID NO: 1531
  chr1:1267466-1268158
  hypo

SEQ ID NO: 4932 - DNA, 224 bp, Homo sapiens
  chr1:2267466-2267690
  hypo
gtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccac

SEQ ID NO: 4933 - DNA, 128 bp, Homo sapiens; identical to SEQ ID NO: 1532
  chr1:6166321-6166449
  hypo

SEQ ID NO: 4934 - DNA, 103 bp, Homo sapiens
  chr1:27190175-27190278
  hypo
gcaagaaggagatgccgcccaccaaccccatccgcctgggcctggccctgaacttttccgtcttccactacgagatcgccaacagccccgaggaggccatctc

SEQ ID NO: 4935 - DNA, 22 bp, Homo sapiens
  chr1:35664724-35664746
  hypo
ccaccggcgctagctattctta

SEQ ID NO: 4936 - DNA, 81 bp, Homo sapiens
  chr1:38398328-38398409
  hypo
acccccggcctattatccccattttatatacaaggcaaccaagttcagagaggttaagtctgaggtcgcagagtgactagc

SEQ ID NO: 4937 - DNA, 156 bp, Homo sapiens; identical to SEQ ID NO: 1533
  chr1:39416821-39416977
  hypo

SEQ ID NO: 4938 - DNA, 145 bp, Homo sapiens
  chr1:41991640-41991785
  hypo
gggcgcaccttccaacgccagccagagttgccctcacatactcacgccgcaccacctgcccctgcctggttccagcacagaggggcaggaggtggctgggaggaggtgagcaagggacagcgtgtcggggcgggggggctccacc

SEQ ID NO: 4939 - DNA, 37 bp, Homo sapiens; identical to SEQ ID NO: 1534
  chr1:45645619-45645656
  hypo

SEQ ID NO: 4940 - DNA, 90 bp, Homo sapiens
  chr1:70672837-70672927
  hypo
gtgctgggattacaggtgtcagtcgccgtgcccagcctgagttttaaaggaaaacgaccgtagcagcttttgcaacgttattaatgaggt

SEQ ID NO: 4941 - DNA, 98 bp, Homo sapiens; identical to SEQ ID NO: 1535
  chr1:86860851-86860949
  hypo

SEQ ID NO: 4942 - DNA, 28 bp, Homo sapiens
  chr1:94343568-94343596
  hypo
aaatcaaaatttggccgggcgcggtggc

SEQ ID NO: 4943 - DNA, 86 bp, Homo sapiens
  chr1:100437183-100437269
  hypo
ttccttttattaaacaagtattacttttttccacatatcctattttttagccaaactagtcgttaattagacgtccagtttctgaa

SEQ ID NO: 4944 - DNA, 41 bp, Homo sapiens
  chr1:109585463-109585504
  hypo
taagaacatcattctcggccaggcgcggtggctcacgcctg

SEQ ID NO: 4945 - DNA, 79 bp, Homo sapiens; identical to SEQ ID NO: 1537
  chr1:151170062-151170141
  hypo

SEQ ID NO: 4946 - DNA, 102 bp, Homo sapiens; identical to SEQ ID NO: 1538
  chr1:151252684-151252786
  hypo

SEQ ID NO: 4947 - DNA, 45 bp, Homo sapiens; identical to SEQ ID NO: 1539
  chr1:153937124-153937169
  hypo

SEQ ID NO: 4948 - DNA, 26 bp, Homo sapiens
  chr1:155578901-155578927
  hypo
actaccgcacccggcccttgccttgt

SEQ ID NO: 4949 - DNA, 40 bp, Homo sapiens; identical to SEQ ID NO: 1540
  chr1:156030121-156030161
  hypo

SEQ ID NO: 4950 - DNA, 16 bp, Homo sapiens
  chr1:158591676-158591692
  hypo
ggagtcttgctctgtc

SEQ ID NO: 4951 - DNA, 15 bp, Homo sapiens
  chr1:158591932-158591947
  hypo
cgtgagccactgcac

SEQ ID NO: 4952 - DNA, 26 bp, Homo sapiens
  chr1:160451209-160451235
  hypo
ctgttcctattcggccatcttggctg

SEQ ID NO: 4953 - DNA, 38 bp, Homo sapiens
  chr1:160693915-160693953
  hypo
ctgtcctcctgaaaacgggtcaggactggccaggcgca

SEQ ID NO: 4954 - DNA, 28 bp, Homo sapiens
  chr1:161367768-161367796
  hypo
gcgtgaaacaccgcgcctggccaaaaaa

SEQ ID NO: 4955 - DNA, 199 bp, Homo sapiens; identical to SEQ ID NO: 1543
  chr1:195732322-195732521
  hypo

SEQ ID NO: 4956 - DNA, 36 bp, Homo sapiens
  chr1:202081768-202081804
  hypo
ccgagcgaaagagcgaaactccgtctcaaaaaaaaa

SEQ ID NO: 4957 - DNA, 31 bp, Homo sapiens
  chr1:212963970-212964001
  hypo
taaaggttaataggccgggcgaggtggctca

SEQ ID NO: 4958 - DNA, 84 bp, Homo sapiens
  chr1:213189757-213189841
  hypo
ttgcaattaatgttgcggaagcacagccatagctctcactttaaaatgtacgtgtatgggccgggcgcggtggctcacgcctgt

SEQ ID NO: 4959 - DNA, 143 bp, Homo sapiens
  chr1:245135719-245135862
  hypo
tgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgc

SEQ ID NO: 4960 - DNA, 30 bp, Homo sapiens
  chr2:9134404-9134434
  hypo
agaatacagtgaaagcggggcatgatggga

SEQ ID NO: 4961 - DNA, 420 bp, Homo sapiens
  chr2:10153023-10153443
  hypo
atggtcgggtcatgtgggcaggcgtgcttatgggcaggtcaggtgggcaggtgtgcatgtgggagagtcaggtggacaggattgaatatgggcgggtcaggtgcgcagacatgcgtatggccgggtcacgtgggcaggcgtgcgtttgggcgggtcaggtgggcaggggtgcatatgggcgggtcaggtggacaggcgcacgtatgggtgagtaagatggacaggcatgtgtgtgggagagtcaggtgaacaggattgcttatgggctagtcaggtggacaggtgtgcgtatgggtgtgcctatgggagagtcaggtggacaggattgcgtatagccggatcaggtgggcaggcatgcgtatgagcgagtcaggtgggcagacatgcgtatgggcgggtcaggtggacaggcgtgtgtat

SEQ ID NO: 4962 - DNA, 240 bp, Homo sapiens
  chr2:10153898-10154138
  hypo
gacacgcgtgcgtatgggcaagtcaggtgggcaggcatgcgtatgggagagtcaggtggacagccctgcgtatgagcgagtcaggtggacaggattgcgtatgggcaagtcaggtggacaggcgtgcgtatgagtgagtcaggtggacaggattgcgtatgggagagtcaggtggacagccctgcgtatgagcgagtcaggtggacaggattgcttatgggcaagtcaggtggacaggcg

SEQ ID NO: 4963 - DNA, 120 bp, Homo sapiens
  chr2:10154318-10154438
  hypo
caggcgtgcatacgggcgggtcaggtgggcaggcgtttgtgtgggccggtcaggtgggcaggtgttcttatggtcgggtcaggtggacaggcatgtgtatgggtgtgcgtatggacgagt

SEQ ID NO: 4964 - DNA, 120 bp, Homo sapiens
  chr2:10154918-10155038
  hypo
ggtcaggtgtgcaggtgtttgtatgggcgggtcaggtgggcaggcgttcgtatggtcaggtcaggtgggcaggtgttcctatggtcaggtcaggtggacaggcgtgcgtatgggtgtgca

SEQ ID NO: 4965 - DNA, 80 bp, Homo sapiens; identical to SEQ ID NO: 1544
  chr2:10156306-10156386
  hypo

SEQ ID NO: 4966 - DNA, 39 bp, Homo sapiens; identical to SEQ ID NO: 1545
  chr2:20642609-20642648
  hypo

SEQ ID NO: 4967 - DNA, 189 bp, Homo sapiens
  chr2:43408168-43408357
  hypo
ctgtgcctgacattacgctgggtgccgcaggtacaatggtgaacgacacagacccaatccctgccctgggagagtgaatcatctagcaacggagacaaatattcaatacacacccaacgcatagttagtgagtattgcagagagtgaagggtgcgatgggatcagatttcccagcgggcccaagagagg

SEQ ID NO: 4968 - DNA, 240 bp, Homo sapiens; identical to SEQ ID NO: 1546
  chr2:47598278-47598518
  hypo

SEQ ID NO: 4969 - DNA, 42 bp, Homo sapiens; identical to SEQ ID NO: 1547
  chr2:47598578-47598620
  hypo

SEQ ID NO: 4970 - DNA, 86 bp, Homo sapiens
  chr2:62589799-62589885
  hypo
cagagggctgcctgacgagggccagagggcagtgctgcagcacacctgagaggaatctttaccgggaactgcgggtggagctgggc

SEQ ID NO: 4971 - DNA, 24 bp, Homo sapiens
  chr2:67625740-67625764
  hypo
tacagccaccgcgcccggccacct

SEQ ID NO: 4972 - DNA, 160 bp, Homo sapiens; identical to SEQ ID NO: 1549
  chr2:74454159-74454319
  hypo

SEQ ID NO: 4973 - DNA, 43 bp, Homo sapiens
  chr2:86423726-86423769
  hypo
ccattgattctgtaatcaaaataaaacacgttaaatattaagc

SEQ ID NO: 4974 - DNA, 140 bp, Homo sapiens
  chr2:88990189-88990329
  hypo
agattcaagagctcacggcctcagagggcaaagcatagttaagaaaatctaggtgataaccggcagttaacagtggcccataccagtgacttgcgctcacggaagagttctgaaggcctggaatgcgtttgaagatgagt

SEQ ID NO: 4975 - DNA, 92 bp, Homo sapiens; identical to SEQ ID NO: 1550
  chr2:97427763-97427855
  hypo

SEQ ID NO: 4976 - DNA, 100 bp, Homo sapiens; identical to SEQ ID NO: 1551
  chr2:99798646-99798746
  hypo

SEQ ID NO: 4977 - DNA, 28 bp, Homo sapiens
  chr2:101835069-101835097
  hypo
gcatgagccaccgcgcccagcctagtca

SEQ ID NO: 4978 - DNA, 223 bp, Homo sapiens
  chr2:122495312-122495535
  hypo
aggcgtgagccaccgcgcccggccctaatttggttattctttcactcacttgtgtgtgagctctcctgtgtggccccgtccgtccgcggcccttggagaacttacagcctgagggcagcatggctgctttaagagaccaaagaggcttgtgggggagaggcacactgggtggcgccggagggtcccccttaggaggtggcgttagcaccgaggcctgaaggct

SEQ ID NO: 4979 - DNA, 59 bp, Homo sapiens
  chr2:127428985-127429044
  hypo
gctttatcacaggcacgagcacaggggagcaacctctccacgcacggggccaggtgtca

SEQ ID NO: 4980 - DNA, 21 bp, Homo sapiens
  chr2:128616617-128616638
  hypo
aaaaatgaattgtgccgggca

SEQ ID NO: 4981 - DNA, 39 bp, Homo sapiens; identical to SEQ ID NO: 1553
  chr2:128847684-128847723
  hypo

SEQ ID NO: 4982 - DNA, 41 bp, Homo sapiens
  chr2:170551801-170551842
  hypo
tttgtgcacatacagcgctggtaggtttttggaactatacc

SEQ ID NO: 4983 - DNA, 27 bp, Homo sapiens
  chr2:170681885-170681912
  hypo
agaggcagggcgcggcggctcacgcct

SEQ ID NO: 4984 - DNA, 27 bp, Homo sapiens
  chr2:170682152-170682179
  hypo
agagcgagactccgtctcaaaaaaaaa

SEQ ID NO: 4985 - DNA, 38 bp, Homo sapiens
  chr2:179317019-179317057
  hypo
aaaaaaaaaaaaaaaaaaaaaagcgatttgttgttttg

SEQ ID NO: 4986 - DNA, 298 bp, Homo sapiens
  chr2:240168811-240169109
  hypo
tggagactagctctgcggtctgctcgtggataaccgcgctccctcgctgccgggccacccgcacagccgggcaaaccaaaaggcccactttttcatgctgtacccaccacttctgtttccccgcaggcatcctactttctaaactaacaccttttcactcccgagaattctaacaaatattatacaattcctacccgcatctaccctccacctggacgtagaacccgtgtgggaggcagtcctgcagggtttggggtggaatatcccccctgtcgagtggagacgaggctgacatgag

SEQ ID NO: 4987 - DNA, 53 bp, Homo sapiens
  chr2:242524008-242524061
  hypo
gaagctctaggtttacggggtcaccttcttgtaggtgacgtgaagatgctgag

SEQ ID NO: 4988 - DNA, 120 bp, Homo sapiens
  chr2:242636861-242636981
  hypo
aaaaaaagtacatgggtaaactgtggaacatccggacgttggaatatttttcaaattaaacatgaactagctattaagccacggaaaggcacgctgggaccttaaatgcatattgctgag

SEQ ID NO: 4989 - DNA, 91 bp, Homo sapiens
  chr2:242637041-242637132
  hypo
aaaagcaaactggaaacagtaaaatgatcagtggttgccaggggcctcgggagggggagagggatgaatcgggaagcgcaggggattttta

SEQ ID NO: 4990 - DNA, 145 bp, Homo sapiens
  chr2:242925496-242925641
  hypo
tctcaaaagatacttcgagcaaaaacaccggacagaagcgtccgtgccagccccgcaggctgcctgtgtgccaggctatcccgtgccatctgatccgggagaagcaggactttcttgcacaggtactcagcgctgtggctgtggg

SEQ ID NO: 4991 - DNA, 45 bp, Homo sapiens
  chr3:42640855-42640900
  hypo
tatatggtcacaaggcgaaggtaattcaatgtataagagtctttt

SEQ ID NO: 4992 - DNA, 33 bp, Homo sapiens
  chr3:48236539-48236572
  hypo
gggcgcggtggctcacgcctgtaatcccagcac

SEQ ID NO: 4993 - DNA, 91 bp, Homo sapiens
  chr3:73045514-73045605
  hypo
ccctcccaaagtgttgggatcaccggcctgagccccctgcccggcctcgctctacgttttttaggcgcattctgaacgtgaagtgtataca

SEQ ID NO: 4994 - DNA, 143 bp, Homo sapiens; identical to SEQ ID NO: 1556
  chr3:101230961-101231104
  hypo

SEQ ID NO: 4995 - DNA, 105 bp, Homo sapiens
  chr3:101397240-101397345
  hypo
caaatgcaccctctgcgaacccaggaggctggtctacgtgtcaggccaaccccactctcctgtcatactgtctttaaatattttggccgggcgcggtgactcacg

SEQ ID NO: 4996 - DNA, 22 bp, Homo sapiens
  chr3:113557437-113557459
  hypo
aagtttccgagcaattcacctt

SEQ ID NO: 4997 - DNA, 19 bp, Homo sapiens
  chr3:122234242-122234261
  hypo
aaaataattaagggccggg

SEQ ID NO: 4998 - DNA, 79 bp, Homo sapiens
  chr3:122234561-122234640
  hypo
ataataataataataatgaaactacatgaaacacatactcgttttactctcaactgctctcaaacgaaaacttggagca

SEQ ID NO: 4999 - DNA, 28 bp, Homo sapiens
  chr3:130519901-130519929
  hypo
tgtaaattggccaggcgtcgtggctcat

SEQ ID NO: 5000 - DNA, 133 bp, Homo sapiens
  chr3:141174349-141174482
  hypo
tgctcctgctgaacacgacgacattccagccaccgggaactgctcgggactcagtatcattctcagacctaggcaggagcgttccgtgcttgccctcctccacaggtgccccgccgcacggggcaaagagtct

SEQ ID NO: 5001 - DNA, 35 bp, Homo sapiens
  chr3:142913215-142913250
  hypo
aaagtctcactttgtcgagcaggctagcatggagt

SEQ ID NO: 5002 - DNA, 126 bp, Homo sapiens
  chr3:169540047-169540173
  hypo
tgtcagcttcctccacgccctgcgcgagctccggctctaccagaccgacctgaaggaaattcccgtcgtcatctttaaaaacctccaccatctcgagctgctcggactgaccggaaaccacctgaa

SEQ ID NO: 5003 - DNA, 235 bp, Homo sapiens; identical to SEQ ID NO: 1557
  chr3:169540374-169540609
  hypo

SEQ ID NO: 5004 - DNA, 18 bp, Homo sapiens
  chr3:182816009-182816027
  hypo
ccccgccaacttccaaca

SEQ ID NO: 5005 - DNA, 30 bp, Homo sapiens
  chr3:183965921-183965951
  hypo
gtgagccaccgcgcccggcagaaatgcatc

SEQ ID NO: 5006 - DNA, 21 bp, Homo sapiens
  chr3:185001914-185001935
  hypo
tacgcgcggccactttccttt

SEQ ID NO: 5007 - DNA, 90 bp, Homo sapiens; identical to SEQ ID NO: 1558
  chr3:185271296-185271386
  hypo

SEQ ID NO: 5008 - DNA, 80 bp, Homo sapiens
  chr3:193312128-193312208
  hypo
gtatagataatttatcgtgtttataaggaatggaatgcattcgttagtttgtttttgttttgttttgagacggagtcttg

SEQ ID NO: 5009 - DNA, 174 bp, Homo sapiens
  chr3:193548530-193548704
  hypo
caaccacctatttatcgttgcccaggctcctaggcctggatctgtcagccagggcctgcccatggccctgggaggtgatgggagtggtggtagtttcagtctctgatgaaagctgctgaaaccggcacggagcacacatgaaaaggacgaaagagaaggcgcaaggctgactgc

SEQ ID NO: 5010 - DNA, 136 bp, Homo sapiens
  chr3:196069836-196069972
  hypo
gggattacaggcgtgagccgccgcgcccggctgaacaagacacttctttaagaaatcatgtacttgagataaacgggtctcgtaaggctagcgttgggactatctcttcatttccatgtggcgagcctcctagggc

SEQ ID NO: 5011 - DNA, 60 bp, Homo sapiens
  chr3:196388383-196388443
  hypo
tcctccaagatcatccgcgtgacggagctgcccggaggtgtgcctcgggactgcaagtgg

SEQ ID NO: 5012 - DNA, 38 bp, Homo sapiens
  chr3:197327004-197327042
  hypo
ttacaggcgtgagccaccgcgcccggcccaattcaaca

SEQ ID NO: 5013 - DNA, 30 bp, Homo sapiens
  chr4:1299450-1299480
  hypo
tgttcttctgggtgccggggttctccagag

SEQ ID NO: 5014 - DNA, 151 bp, Homo sapiens
  chr4:2066114-2066265
  hypo
ggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtgg

SEQ ID NO: 5015 - DNA, 236 bp, Homo sapiens
  chr4:2305682-2305918
  hypo
aggggcgggatgggccggggctgcggcaggtgagctgagggcttggcactgcgcccatgtcacctgacaggcacccggaacatcagaaacagggaagcgggcccgctggcgcacattttctggtgcatgacgccccacagggcaggtgcctctgcagccagctcctgcccctgcccctcctcacacacagaccccacactcggccagggcccagcacctgccggtggccaagatgg

SEQ ID NO: 5016 - DNA, 158 bp, Homo sapiens
  chr4:3447821-3447979
  hypo
ccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtcca

SEQ ID NO: 5017 - DNA, 98 bp, Homo sapiens
  chr4:39816677-39816775
  hypo
ctgggcaagaaaagacgagaaagttttcctgtcgatgtggcctcttggaggctgaactgtgtggcaatgtaactagaaactggagactttatttattt

SEQ ID NO: 5018 - DNA, 38 bp, Homo sapiens
  chr4:39817075-39817113
  hypo
ggcgtgagccaccgcgcccagcccgaaactggagactt

SEQ ID NO: 5019 - DNA, 150 bp, Homo sapiens
  chr4:75241329-75241479
  hypo
gccaccgcgcccggcctgaccagcgattcttaaggttaacaggatagtggatgtaatatttctctggagatagattttttattcattggatcgcattcactcttctaccctagtttgcaagtgtttgggagcagacgcatattgcaggaa

SEQ ID NO: 5020 - DNA, 86 bp, Homo sapiens; identical to SEQ ID NO: 1559
  chr4:95127609-95127695
  hypo

SEQ ID NO: 5021 - DNA, 18 bp, Homo sapiens
  chr4:95762911-95762929
  hypo
attcggccatcttggctc

SEQ ID NO: 5022 - DNA, 420 bp, Homo sapiens
  chr5:491335-491755
  hypo
gcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagcca

SEQ ID NO: 5023 - DNA, 617 bp, Homo sapiens
  chr5:554299-554916
  hypo
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacaggatgacccgggggtgggtcacgggataaaccaggggtggggggctgggtcacgggatgaacggggggcgggtcacaggatgaaccgtgggcgggtcatgggataaaccagggtggggtctgggtcacaggatgacccgggggtgggtcacgggataaaccaggggtggggggtgggtcacgggatgaacggggggcgggtcacaggatgaaccgtgggtgggtcatgggataaaccagggtggggtctgggtcacgggatgaacggggttgggggctgggtcacgggatgaaccggggggtgggtcacgggatgaacggggggggggtgggtcacgggctaaaccgg

SEQ ID NO: 5024 - DNA, 17 bp, Homo sapiens
  chr5:555156-555173
  hypo
aacgggggggtgggtca

SEQ ID NO: 5025 - DNA, 140 bp, Homo sapiens
  chr5:677883-678023
  hypo
tgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctcc

SEQ ID NO: 5026 - DNA, 125 bp, Homo sapiens
  chr5:1174263-1174388
  hypo
ggtgacactggaactcgttctgcttgttaaaaatttcaaaccggaacgagactttggagcttattttgtccaagccttttatttttcaaaggaggcaactgcactgagagcgttagactcaaggt

SEQ ID NO: 5027 - DNA, 836 bp, Homo sapiens; identical to SEQ ID NO: 409
  chr5:1294607-1295443
  hypo

SEQ ID NO: 5028 - DNA, 275 bp, Homo sapiens
  chr5:3324844-3325119
  hypo
caagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccctcaaggggagagggccgcatccctgttccccgccttcctcgccatgactggacgcagcggggcgccctgtccctgcc

SEQ ID NO: 5029 - DNA, 104 bp, Homo sapiens
  chr5:17203073-17203177
  hypo
gtgatgacaggactgtgaagcagtgggaattggagggctcaggctatggagaaggggaagtccttttgcatatggtattaagaaggcggcggacactgggactg

SEQ ID NO: 5030 - DNA, 33 bp, Homo sapiens; identical to SEQ ID NO: 1561
  chr5:43402630-43402663
  hypo

SEQ ID NO: 5031 - DNA, 22 bp, Homo sapiens
  chr5:68391002-68391024
  hypo
gtaatagcattataacgtaact

SEQ ID NO: 5032 - DNA, 31 bp, Homo sapiens
  chr5:79783240-79783271
  hypo
acagtctagctctatcgcacagaccggagcg

SEQ ID NO: 5033 - DNA, 90 bp, Homo sapiens
  chr5:79947584-79947674
  hypo
ctaaaacactctttacgccggtttctattgacttgggttaatcgtgtgaccgcggtggctggcacgaacttgacgaaccctagggttagt

SEQ ID NO: 5034 - DNA, 30 bp, Homo sapiens
  chr5:79947734-79947764
  hypo
tgtggctaggctaagcgttttgagctgcgt

SEQ ID NO: 5035 - DNA, 86 bp, Homo sapiens
  chr5:94982139-94982225
  hypo
ttatacatgggttaccagcatcgcgacgaccttctgcaaatatttttatagggtaaataactgaatgaagtcgctgggcgcatcta

SEQ ID NO: 5036 - DNA, 30 bp, Homo sapiens; identical to SEQ ID NO: 1562
  chr5:154209957-154209987
  hypo

SEQ ID NO: 5037 - DNA, 19 bp, Homo sapiens
  chr5:154318148-154318167
  hypo
atatgcacaagaggccggg

SEQ ID NO: 5038 - DNA, 71 bp, Homo sapiens
  chr5:169532927-169532998
  hypo
ccaggcaggtggctccggccagcccagccccagcatgagctccttcgacctgccggcgccctccccacctc

SEQ ID NO: 5039 - DNA, 20 bp, Homo sapiens
  chr5:177019993-177020013
  hypo
ccttctgtcacttttcgtta

SEQ ID NO: 5040 - DNA, 332 bp, Homo sapiens
  chr6:3285157-3285489
  hypo
atagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggc

SEQ ID NO: 5041 - DNA, 30 bp, Homo sapiens; identical to SEQ ID NO: 1564
  chr6:4951289-4951319
  hypo

SEQ ID NO: 5042 - DNA, 186 bp, Homo sapiens; identical to SEQ ID NO: 1565
  chr6:12288517-12288703
  hypo

SEQ ID NO: 5043 - DNA, 120 bp, Homo sapiens
  chr6:34170868-34170988
  hypo
cttctgtcggctccatggagccggaggcccgggtctgcctccgtttggtttgggtggccatggtttgggtggctgcagcggcaccccagggcgctcctgcccccaactcagaaggggcgg

SEQ ID NO: 5044 - DNA, 31 bp, Homo sapiens
  chr6:34171048-34171079
  hypo
tgatggcagcagccaccgccaggagtgtggg

SEQ ID NO: 5045 - DNA, 66 bp, Homo sapiens
  chr6:35150041-35150107
  hypo
gagaatcagggcccacgtggcgggcgagggatctgcgacgcagccaccgggcgcccagctggggtc

SEQ ID NO: 5046 - DNA, 251 bp, Homo sapiens
  chr6:37024382-37024633
  hypo
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctcc

SEQ ID NO: 5047 - DNA, 36 bp, Homo sapiens
  chr6:42062066-42062102
  hypo
gcctgagcaacacagcgacaccccatcttttttttt

SEQ ID NO: 5048 - DNA, 180 bp, Homo sapiens
  chr6:52928863-52929043
  hypo
gggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtctcactctg

SEQ ID NO: 5049 - DNA, 97 bp, Homo sapiens; identical to SEQ ID NO: 1566
  chr6:86302345-86302442
  hypo

SEQ ID NO: 5050 - DNA, 29 bp, Homo sapiens
  chr6:99396702-99396731
  hypo
gctgggattacagccgtgagccaccgcgc

SEQ ID NO: 5051 - DNA, 24 bp, Homo sapiens
  chr6:134067447-134067471
  hypo
gagccaccgcgcccagcctgcctg

SEQ ID NO: 5052 - DNA, 104 bp, Homo sapiens; identical to SEQ ID NO: 1568
  chr6:134589500-134589604
  hypo

SEQ ID NO: 5053 - DNA, 99 bp, Homo sapiens
  chr6:137144497-137144596
  hypo
aggaatgcacacattcgcaagtaggtgttacagactccagttaattgtctcccgtcgcgcgcattggctcagcctgtggttaaagctgctcaggaggct

SEQ ID NO: 5054 - DNA, 18 bp, Homo sapiens
  chr6:164114295-164114313
  hypo
ttatttttttgagaccga

SEQ ID NO: 5055 - DNA, 47 bp, Homo sapiens
  chr7:1030172-1030219
  hypo
ccaggacgtggtggccgggacacacgggtgcacggcaggcctcacac

SEQ ID NO: 5056 - DNA, 89 bp, Homo sapiens; identical to SEQ ID NO: 1569
  chr7:1641847-1641936
  hypo

SEQ ID NO: 5057 - DNA, 164 bp, Homo sapiens; identical to SEQ ID NO: 1570
  chr7:1733214-1733378
  hypo

SEQ ID NO: 5058 - DNA, 190 bp, Homo sapiens
  chr7:3283704-3283894
  hypo
aagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctgg

SEQ ID NO: 5059 - DNA, 85 bp, Homo sapiens; identical to SEQ ID NO: 1571
  chr7:6124629-6124714
  hypo

SEQ ID NO: 5060 - DNA, 180 bp, Homo sapiens
  chr7:6524907-6525087
  hypo
aaacttgaatatttctacgggatggggacgtcacaagaaattgcaaacaaaaaaagctgacaaacaggatctgctacataatttgcgggacggagtgcaaaacaaaaacgcacagttcgcagttcaaaaagcagggcgggggcgaggacctggtgcggtggctcatgcctgtagtcccaa

SEQ ID NO: 5061 - DNA, 273 bp, Homo sapiens; identical to SEQ ID NO: 1572
  chr7:7605157-7605430
  hypo

SEQ ID NO: 5062 - DNA, 152 bp, Homo sapiens; identical to SEQ ID NO: 1573
  chr7:7605670-7605822
  hypo

SEQ ID NO: 5063 - DNA, 24 bp, Homo sapiens
  chr7:25132702-25132726
  hypo
gcgatactccgtctcaaaaaaaaa

SEQ ID NO: 5064 - DNA, 84 bp, Homo sapiens
  chr7:36428640-36428724
  hypo
gctactgaaggccaacgggctagcagcacctgaaacacaagggctctttgtctggctctgtagcccaggctggaatgcagtggt

SEQ ID NO: 5065 - DNA, 41 bp, Homo sapiens
  chr7:44151615-44151656
  hypo
gaaccctgatggctacgaggtggcagcgcagatggtgggtt

SEQ ID NO: 5066 - DNA, 264 bp, Homo sapiens; identical to SEQ ID NO: 1574
  chr7:44835120-44835384
  hypo

SEQ ID NO: 5067 - DNA, 20 bp, Homo sapiens
  chr7:45027140-45027160
  hypo
cagagcgagactctgtctca

SEQ ID NO: 5068 - DNA, 78 bp, Homo sapiens
  chr7:56018123-56018201
  hypo
aatcattgatgttgtcggggtagggaccagagttctaactgtggaagaaaggagataaaaatacggaactggtgaagc

SEQ ID NO: 5069 - DNA, 67 bp, Homo sapiens
  chr7:101652623-101652690
  hypo
acccctcacctaggccgcacagcaccctaatgtacacactgaagaaaggctgcgtggggctgcagag

SEQ ID NO: 5070 - DNA, 30 bp, Homo sapiens; identical to SEQ ID NO: 1575
  chr7:128097589-128097619
  hypo

SEQ ID NO: 5071 - DNA, 95 bp, Homo sapiens
  chr7:148640241-148640336
  hypo
agaatcttgttcaatgtgctaaatgtgataggcacttcaatatccacttcaggtgacaaataattagaaatgaggtccaccgtgaaggaaatgga

SEQ ID NO: 5072 - DNA, 223 bp, Homo sapiens; identical to SEQ ID NO: 1576
  chr7:155581330-155581553
  hypo

SEQ ID NO: 5073 - DNA, 97 bp, Homo sapiens
  chr7:156744702-156744799
  hypo
tttgatttttatcatataaacttagatattacttttaaacaagtttgaaattgtttttaggacactttccctccaaaattagcggtttgtttaattt

SEQ ID NO: 5074 - DNA, 884 bp, Homo sapiens
  chr7:157262579-157263463
  hypo
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggag

SEQ ID NO: 5075 - DNA, 39 bp, Homo sapiens
  chr8:37961863-37961902
  hypo
acaacaagaaaacacaaaattctgcgaccatatgttaaa

SEQ ID NO: 5076 - DNA, 32 bp, Homo sapiens
  chr8:42749968-42750000
  hypo
ttacaggcgcgagacaccgcgcctggccacgt

SEQ ID NO: 5077 - DNA, 115 bp, Homo sapiens
  chr8:58130301-58130416
  hypo
ggaagacacatctgacgagatcgaatgttttgcagaagagccatgtgaccagatccctggtttggcagaggagacatgcgagaagacggaacgttttggccgaggagacatctgg

SEQ ID NO: 5078 - DNA, 22 bp, Homo sapiens
  chr8:66560523-66560545
  hypo
ttacaggcgtgagtcaccatgc

SEQ ID NO: 5079 - DNA, 137 bp, Homo sapiens; identical to SEQ ID NO: 1578
  chr8:90913516-90913653
  hypo

SEQ ID NO: 5080 - DNA, 99 bp, Homo sapiens
  chr8:92083523-92083622
  hypo
gaaataaatgtttgtcgttgcctacaccatttgaaaacagctgtccacttctgttaaatgttaaactgcttttttttttttttttgagacggtgtctcg

SEQ ID NO: 5081 - DNA, 16 bp, Homo sapiens
  chr8:103629866-103629882
  hypo
acgtagacctaacaaa

SEQ ID NO: 5082 - DNA, 91 bp, Homo sapiens; identical to SEQ ID NO: 1580
  chr8:133686745-133686836
  hypo

SEQ ID NO: 5083 - DNA, 17 bp, Homo sapiens
  chr8:135301235-135301252
  hypo
gccggccagatcccaca

SEQ ID NO: 5084 - DNA, 119 bp, Homo sapiens
  chr8:140834148-140834267
  hypo
tcgtagtgccatgctcggctattggctgggcctaaattgttccttactctgagaattcgttaagtggctgagcaataaagaagagagatttgagagttctttctcggcacaatggcttt

SEQ ID NO: 5085 - DNA, 38 bp, Homo sapiens
  chr8:141588102-141588140
  hypo
gctacaatgcacacccgtggagtcggctggcagacaat

SEQ ID NO: 5086 - DNA, 198 bp, Homo sapiens
  chr8:143993967-143994165
  hypo
tctgcctctgccaggcgccgcccgaggcactggcgcatgccaaagccaaagggcacgtggtggaagttcctgccggagcccctgatgtctagccagcgctggggattataccgctcaggcctcgggaacaaggcggcattgcgacccagcgagtagaggaaaacctgtaccaatgtctgcggacggtgcagagcaggg

SEQ ID NO: 5087 - DNA, 98 bp, Homo sapiens
  chr8:146079215-146079313
  hypo
ggtacatgaagccttcggcattgttggctattagagaaatgcgaatggaagccacggggaggtgccatttcataccattagaagggttataataaaaa

SEQ ID NO: 5088 - DNA, 105 bp, Homo sapiens; identical to SEQ ID NO: 1581
  chr9:6756353-6756458
  hypo

SEQ ID NO: 5089 - DNA, 30 bp, Homo sapiens
  chr9:37467610-37467640
  hypo
cctatagatacaaaacgaaagtaataaaac

SEQ ID NO: 5090 - DNA, 30 bp, Homo sapiens
  chr9:37467940-37467970
  hypo
aaaaaaaaaaaagagcgggtctccttaatt

SEQ ID NO: 5091 - DNA, 90 bp, Homo sapiens
  chr9:100397609-100397699
  hypo
taaataactatgctgcgtgctttgatttctaacacgaggtttcttgtgtaacctctgtacaaggcacagaaaatacaattccctcccttt

SEQ ID NO: 5092 - DNA, 22 bp, Homo sapiens
  chr9:131580093-131580115
  hypo
tttgccaatctgggccgggcgc

SEQ ID NO: 5093 - DNA, 221 bp, Homo sapiens
  chr9:131854231-131854452
  hypo
tgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggt

SEQ ID NO: 5094 - DNA, 126 bp, Homo sapiens
  chr9:133773766-133773892
  hypo
tgctgctagggagggcgcagggtggtggcccccatctaagcccgggtcccctgggctgttggcaactgccgctccggttctgctggccgaacccctcctgccctgggaagccgcttcccatgctgt

SEQ ID NO: 5095 - DNA, 202 bp, Homo sapiens
  chr9:135898911-135899113
  hypo
cccactgcagggaaacggttaaaatgcgctgggcttcgtttttcccggaagccctcattacctggtattaccttaggtgtggattcctttattcgcctgctgtctgtctctgccaatcaaatgtgagctccgtgagggcggaggggggcggtcctctcggcttcatcatccgagcccagcacaggatcgggcacatcgcggg

SEQ ID NO: 5096 - DNA, 68 bp, Homo sapiens
  chr9:138563212-138563280
  hypo
aaggcacctggctcccgcaccctcgacggggccctgcccagtggacacgaccacgtggaagcctcttc

SEQ ID NO: 5097 - DNA, 165 bp, Homo sapiens
  chr9:138627636-138627801
  hypo
tgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagcca

SEQ ID NO: 5098 - DNA, 35 bp, Homo sapiens
  chr9:138650129-138650164
  hypo
cccgtgggcctcagccgagacgcaggtgtggccgg

SEQ ID NO: 5099 - DNA, 121 bp, Homo sapiens; identical to SEQ ID NO: 1583
  chr9:139012272-139012393
  hypo

SEQ ID NO: 5100 - DNA, 17 bp, Homo sapiens
  chr9:139703929-139703946
  hypo
atgaaagttggtgtccg

SEQ ID NO: 5101 - DNA, 136 bp, Homo sapiens; identical to SEQ ID NO: 1585
  chr9:139704066-139704202
  hypo

SEQ ID NO: 5102 - DNA, 268 bp, Homo sapiens
  chr9:140127812-140128080
  hypo
tcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggccc

SEQ ID NO: 5103 - DNA, 37 bp, Homo sapiens; identical to SEQ ID NO: 1586
  chr10:5875322-5875359
  hypo

SEQ ID NO: 5104 - DNA, 39 bp, Homo sapiens
  chr10:15140487-15140526
  hypo
tgggattacaggcgtgagccacctcgccagccaacttat

SEQ ID NO: 5105 - DNA, 226 bp, Homo sapiens; identical to SEQ ID NO: 1587
  chr10:98129781-98130007
  hypo

SEQ ID NO: 5106 - DNA, 22 bp, Homo sapiens
  chr10:98528164-98528186
  hypo
cagaccacggactgatacaggt

SEQ ID NO: 5107 - DNA, 44 bp, Homo sapiens
  chr10:105155356-105155400
  hypo
taactgctcttaaatgtaactaatccttccgtgcctctctccac

SEQ ID NO: 5108 - DNA, 29 bp, Homo sapiens
  chr10:131936597-131936626
  hypo
caggcttgagcccccgtgacctgccctgt

SEQ ID NO: 5109 - DNA, 421 bp, Homo sapiens; identical to SEQ ID NO: 1589
  chr10:133951502-133951923
  hypo

SEQ ID NO: 5110 - DNA, 212 bp, Homo sapiens; identical to SEQ ID NO: 1590
  chr10:134095580-134095792
  hypo

SEQ ID NO: 5111 - DNA, 274 bp, Homo sapiens
  chr10:134607922-134608196
  hypo
tctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 5112 - DNA, 471 bp, Homo sapiens
  chr10:134733221-134733692
  hypo
acgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagg

SEQ ID NO: 5113 - DNA, 594 bp, Homo sapiens
  chr10:134942531-134943125
  hypo
cctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagcc

SEQ ID NO: 5114 - DNA, 257 bp, Homo sapiens
  chr11:1464204-1464461
  hypo
cagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgc

SEQ ID NO: 5115 - DNA, 48 bp, Homo sapiens
  chr11:1868130-1868178
  hypo
tcagtgctgctggggcgaggcatacacctgtgacgggacctcaggacg

SEQ ID NO: 5116 - DNA, 163 bp, Homo sapiens; identical to SEQ ID NO: 1591
  chr11:9405392-9405555
  hypo

SEQ ID NO: 5117 - DNA, 171 bp, Homo sapiens
  chr11:60941596-60941767
  hypo
ctgaatagccatccacgcagaaagctgggagaagaaccttctggacagggagaacaggaattgcaaaggcccaaggtaaccaagttcaataaaaggctacttttccatctccagtcttccgtccacacctgaacacaccatcgtcaaccaggccatcgaggccacaagtta

SEQ ID NO: 5118 - DNA, 28 bp, Homo sapiens
  chr11:64578577-64578605
  hypo
gtttgttttgagacacggtctttctctt

SEQ ID NO: 5119 - DNA, 99 bp, Homo sapiens
  chr11:66511245-66511344
  hypo
caggtcccacctttgcgggggaagctggtccccctggattaggctgggagatgcttggggctggttgtaaggtaaaagacggggggtcgttttttcttt

SEQ ID NO: 5120 - DNA, 82 bp, Homo sapiens; identical to SEQ ID NO: 1592
  chr11:66513182-66513264
  hypo

SEQ ID NO: 5121 - DNA, 82 bp, Homo sapiens; identical to SEQ ID NO: 1593
  chr11:66513564-66513646
  hypo

SEQ ID NO: 5122 - DNA, 157 bp, Homo sapiens; identical to SEQ ID NO: 1594
  chr11:67072239-67072396
  hypo

SEQ ID NO: 5123 - DNA, 93 bp, Homo sapiens
  chr11:67797202-67797295
  hypo
cctacctaccctcagcgcagatcctcccaacacacacatgcaggcagcctcggggcctctgcgggtccctctaccacagcattcccggggaaa

SEQ ID NO: 5124 - DNA, 72 bp, Homo sapiens; identical to SEQ ID NO: 1595
  chr11:69280561-69280633
  hypo

SEQ ID NO: 5125 - DNA, 34 bp, Homo sapiens
  chr11:72475677-72475711
  hypo
ccatctttgttcctgcgggcggcggtggccacgc

SEQ ID NO: 5126 - DNA, 348 bp, Homo sapiens
  chr11:76371738-76372086
  hypo
gggctgaccagccctcggaaggtgcgtggatgcccttgctgtcctggggtggccctgtggggagccggatgaggttgttggacaagttcaggtagatgagtctcgggagcgcggccaggtcggggaaatggagcagtttgttctcccgcaggtcaagccaggtgagctggaactcagcctggggctgggaggccgtctgaaaggcctcgatgctgttgcagctcaggtctagcacccgcagctgctggaggctgaagtcggagatgcaggtgagggaattcctggagaggttgagatgggtcaggcggggcagaccctcgaaggcgccatcctcgatgtccatcagca

SEQ ID NO: 5127 - DNA, 45 bp, Homo sapiens; identical to SEQ ID NO: 1596
  chr11:102961347-102961392
  hypo

SEQ ID NO: 5128 - DNA, 194 bp, Homo sapiens
  chr12:2566053-2566247
  hypo
gtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattcatttgcgcagcacgcacctcctgagca

SEQ ID NO: 5129 - DNA, 295 bp, Homo sapiens
  chr12:2964499-2964794
  hypo
tggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctg

SEQ ID NO: 5130 - DNA, 89 bp, Homo sapiens; identical to SEQ ID NO: 1597
  chr12:12848467-12848556
  hypo

SEQ ID NO: 5131 - DNA, 147 bp, Homo sapiens; identical to SEQ ID NO: 1598
  chr12:49657607-49657754
  hypo

SEQ ID NO: 5132 - DNA, 235 bp, Homo sapiens
  chr12:51421351-51421586
  hypo
gcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctag

SEQ ID NO: 5133 - DNA, 21 bp, Homo sapiens
  chr12:51565449-51565470
  hypo
cgcacccggccgaaaggagat

SEQ ID NO: 5134 - DNA, 20 bp, Homo sapiens
  chr12:51930773-51930793
  hypo
gagcatgaagctgggcgctg

SEQ ID NO: 5135 - DNA, 97 bp, Homo sapiens; identical to SEQ ID NO: 1599
  chr12:54720206-54720303
  hypo

SEQ ID NO: 5136 - DNA, 212 bp, Homo sapiens
  chr12:57881112-57881324
  hypo
ctttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctgga

SEQ ID NO: 5137 - DNA, 75 bp, Homo sapiens
  chr12:58241524-58241599
  hypo
aaggggtgtgtgcgtgtgggcggacctaggactccagagtataagagctggaactgacctcgggactgtgtcccc

SEQ ID NO: 5138 - DNA, 29 bp, Homo sapiens
  chr12:68978592-68978621
  hypo
aaaagctttttttccgttttcactagaaa

SEQ ID NO: 5139 - DNA, 23 bp, Homo sapiens
  chr12:96881015-96881038
  hypo
gtgagccacgacacccagccaat

SEQ ID NO: 5140 - DNA, 101 bp, Homo sapiens; identical to SEQ ID NO: 1601
  chr12:122278479-122278580
  hypo

SEQ ID NO: 5141 - DNA, 301 bp, Homo sapiens
  chr12:130821371-130821672
  hypo
atcttacaatatttccggttgttttgtggctgttgactttgcctccatgaggaaattaactcctatggagggcacctagctcggcgtagacccggtcgctaccacctgcgatgccttggaaatgcagccggcggggcccacctgtggagcctgcagaccggaatctctggtctgtgtcctaaccagccctgcaggtgatcccccgcaggtgaaggctgagaacccctgcggtccacgttggcatgcacccaaggcacaagtcattgaaagctaaatttccaggtaacggcctcctggcacc

SEQ ID NO: 5142 - DNA, 522 bp, Homo sapiens; identical to SEQ ID NO: 1602
  chr12:132221602-132222124
  hypo

SEQ ID NO: 5143 - DNA, 158 bp, Homo sapiens
  chr12:132423555-132423713
  hypo
gattacaggcgtgagccactatgcccggccctccagatgcatttttaacagctgaattcatgtgtgaaatgacgtaaggtccgcgtagtccttctttctcagagaccagcgtgcgaggcccaagggacccaccttccgtcacccgttctgctttgttt

SEQ ID NO: 5144 - DNA, 20 bp, Homo sapiens
  chr13:96031715-96031735
  hypo
atgaccggccgggcacggtg

SEQ ID NO: 5145 - DNA, 462 bp, Homo sapiens
  chr13:110434424-110434886
  hypo
agaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgt

SEQ ID NO: 5146 - DNA, 35 bp, Homo sapiens
  chr13:111278361-111278396
  hypo
acaccagagaggagccggcgcggagctccaggtgc

SEQ ID NO: 5147 - DNA, 159 bp, Homo sapiens
  chr13:114304752-114304911
  hypo
gcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacac

SEQ ID NO: 5148 - DNA, 265 bp, Homo sapiens
  chr13:114748399-114748664
  hypo
ggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcacttt

SEQ ID NO: 5149 - DNA, 528 bp, Homo sapiens; identical to SEQ ID NO: 1603
  chr13:114780555-114781083
  hypo

SEQ ID NO: 5150 - DNA, 198 bp, Homo sapiens
  chr14:23776958-23777156
  hypo
cctcttatagccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcacc

SEQ ID NO: 5151 - DNA, 37 bp, Homo sapiens
  chr14:31027390-31027427
  hypo
tacaggcgtgagccaccgcgcccggccctcaaactgt

SEQ ID NO: 5152 - DNA, 83 bp, Homo sapiens
  chr14:67886562-67886645
  hypo
ctcaaaaaaaaaaaaaggctgcatccattcgctaagccacatggcagtgggtctgcatctccccagagcgggtgcttttttct

SEQ ID NO: 5153 - DNA, 149 bp, Homo sapiens
  chr14:73167750-73167899
  hypo
ctccttttatcatgtcggcattctcactctggaaatatctgtcgtgcggaatcagcctgagccccaggagcgctgaagcagcagagagggtcatgccccatcttcccactccagtctccttccccgggggcaagcgcttttgcaccatg

SEQ ID NO: 5154 - DNA, 273 bp, Homo sapiens
  chr14:93154937-93155210
  hypo
cacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcgg

SEQ ID NO: 5155 - DNA, 49 bp, Homo sapiens
  chr15:59158488-59158537
  hypo
acagcaggtatgggccgactcactgtctggggcccgcccagcccagccc

SEQ ID NO: 5156 - DNA, 96 bp, Homo sapiens
  chr15:66649845-66649941
  hypo
cccagaagttgaaggcggcagtgactaggatcgcactgctggcgatccagctggagatccagtctgggtgacagtgagatcttgtcgcaaaaaaaa

SEQ ID NO: 5157 - DNA, 220 bp, Homo sapiens
  chr15:72412089-72412309
  hypo
gcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 5158 - DNA, 85 bp, Homo sapiens; identical to SEQ ID NO: 1604
  chr15:78596048-78596133
  hypo

SEQ ID NO: 5159 - DNA, 154 bp, Homo sapiens
  chr16:612869-613023
  hypo
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctc

SEQ ID NO: 5160 - DNA, 283 bp, Homo sapiens; identical to SEQ ID NO: 1605
  chr16:726729-727012
  hypo

SEQ ID NO: 5161 - DNA, 748 bp, Homo sapiens
  chr16:734930-735678
  hypo
cagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcaggatctgggtgccaggggcggcgctgcaggggggaggccccgcccaccacacacctgggtctgctcgtcgatgtccttgcgcacccgttcacccaggacgatgagcacagacacagccatctgcacgtcgccctgctcagcgtagaagtgcagcatgtcgcgcaccagcacgccgaagaagtcgggcggcaggcggctgtcgtagagcgcgtgtgagacagacaggagcgagaaggaggagtccacgggggccagggaggccacatccgcctcgctgccgctcacgtgcggggagtcggccttgtcctgcaggtgctcgggcccgggaggcgtgtccacgatctcgtggcgcagcggaaaggcctcctgcggcagcacgcactcagggtcctcggctggaaggcagggaccagcggaggctctgagtctgtcctccatccgcctctgaaccccaccctgcccggacccccactcac

SEQ ID NO: 5162 - DNA, 230 bp, Homo sapiens
  chr16:837308-837538
  hypo
aatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggct

SEQ ID NO: 5163 - DNA, 205 bp, Homo sapiens; identical to SEQ ID NO: 1606
  chr16:845955-846160
  hypo

SEQ ID NO: 5164 - DNA, 28 bp, Homo sapiens
  chr16:1407453-1407481
  hypo
agtcacccagcacctcgtgtgtatttcg

SEQ ID NO: 5165 - DNA, 145 bp, Homo sapiens
  chr16:1428508-1428653
  hypo
gatcccaccaggctccgtgctaagtcggcagaagcttcacccaccagctgcagagtgcgcagcatgtggaggggctaagctgccttcaatgctcacccgacaaactacggctcgcactcaactcagagggcgtcagccaccacct

SEQ ID NO: 5166 - DNA, 147 bp, Homo sapiens
  chr16:2029023-2029170
  hypo
ggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcg

SEQ ID NO: 5167 - DNA, 336 bp, Homo sapiens; identical to SEQ ID NO: 1608
  chr16:2234684-2235020
  hypo

SEQ ID NO: 5168 - DNA, 117 bp, Homo sapiens
  chr16:2770122-2770239
  hypo
cagcagcagcaggagcggcaccgccgccggccgcctcatgtcctcaggcctggctggggcgcagggccgtggtcggcggtggcagaagcgttggagcacgagcgaggtgcaggctcc

SEQ ID NO: 5169 - DNA, 82 bp, Homo sapiens
  chr16:2770456-2770538
  hypo
ccccccagcagaccccgagctgaccgcggtgcacgcgaagtccgtccagcttcattcattattattattattatttttttta

SEQ ID NO: 5170 - DNA, 30 bp, Homo sapiens
  chr16:18802453-18802483
  hypo
gtgagccaccacacccggctaaaaattttt

SEQ ID NO: 5171 - DNA, 45 bp, Homo sapiens
  chr16:18950973-18951018
  hypo
gctgggattacaggcgtgagtcaccgtgcccggccctcctgcaac

SEQ ID NO: 5172 - DNA, 337 bp, Homo sapiens
  chr16:30017290-30017627
  hypo
atttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgg

SEQ ID NO: 5173 - DNA, 294 bp, Homo sapiens
  chr16:30124567-30124861
  hypo
tcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 5174 - DNA, 197 bp, Homo sapiens; identical to SEQ ID NO: 1609
  chr16:31446899-31447096
  hypo

SEQ ID NO: 5175 - DNA, 18 bp, Homo sapiens
  chr16:68876852-68876870
  hypo
tttgagatggagtctcgc

SEQ ID NO: 5176 - DNA, 465 bp, Homo sapiens; identical to SEQ ID NO: 1611
  chr16:87723648-87724113
  hypo

SEQ ID NO: 5177 - DNA, 312 bp, Homo sapiens; identical to SEQ ID NO: 1612
  chr16:88943712-88944024
  hypo

SEQ ID NO: 5178 - DNA, 160 bp, Homo sapiens
  chr16:88955208-88955368
  hypo
ccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccaggg

SEQ ID NO: 5179 - DNA, 541 bp, Homo sapiens
  chr16:88957405-88957946
  hypo
tcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaa

SEQ ID NO: 5180 - DNA, 549 bp, Homo sapiens
  chr16:88963214-88963763
  hypo
gccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctg

SEQ ID NO: 5181 - DNA, 271 bp, Homo sapiens
  chr16:89072503-89072774
  hypo
ggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctg

SEQ ID NO: 5182 - DNA, 93 bp, Homo sapiens
  chr16:89120243-89120336
  hypo
gtgcagggagaaggccgggcgggtgctggggggcccgtctccctgtgactcgtggacggtgcggtgcagggagaagggcgggcaggtgctgga

SEQ ID NO: 5183 - DNA, 71 bp, Homo sapiens; identical to SEQ ID NO: 1613
  chr16:89220327-89220398
  hypo

SEQ ID NO: 5184 - DNA, 385 bp, Homo sapiens
  chr16:89220641-89221026
  hypo
gtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcct

SEQ ID NO: 5185 - DNA, 55 bp, Homo sapiens
  chr16:89558648-89558703
  hypo
cctgataaaaacagccggcgtatgcgctgatgtgcgttcacgaagaggtgatcca

SEQ ID NO: 5186 - DNA, 233 bp, Homo sapiens
  chr16:89883952-89884185
  hypo
ccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggca

SEQ ID NO: 5187 - DNA, 32 bp, Homo sapiens
  chr17:1136665-1136697
  hypo
gcgtgacccaccgcgcccggcctctttctttc

SEQ ID NO: 5188 - DNA, 120 bp, Homo sapiens; identical to SEQ ID NO: 1614
  chr17:2207818-2207938
  hypo

SEQ ID NO: 5189 - DNA, 36 bp, Homo sapiens
  chr17:2220961-2220997
  hypo
actgcactccagccgggataacggagactccatctc

SEQ ID NO: 5190 - DNA, 30 bp, Homo sapiens; identical to SEQ ID NO: 1615
  chr17:3658849-3658879
  hypo

SEQ ID NO: 5191 - DNA, 268 bp, Homo sapiens
  chr17:18163086-18163354
  hypo
ccctacccagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 5192 - DNA, 142 bp, Homo sapiens; identical to SEQ ID NO: 1616
  chr17:25620573-25620715
  hypo

SEQ ID NO: 5193 - DNA, 33 bp, Homo sapiens; identical to SEQ ID NO: 1617
  chr17:26927180-26927213
  hypo

SEQ ID NO: 5194 - DNA, 20 bp, Homo sapiens
  chr17:27170162-27170182
  hypo
tttttttttctgagtcgaag

SEQ ID NO: 5195 - DNA, 86 bp, Homo sapiens
  chr17:27716046-27716132
  hypo
catacactgtatacacggattgcttaggtctgatcaacatgctccttccttggagcacagatctactatggccagcctggtctcga

SEQ ID NO: 5196 - DNA, 85 bp, Homo sapiens
  chr17:27716192-27716277
  hypo
gagccaccgggcccggcccagagttaatttttattcatgaaactcatataacaggtttatttatttcagtcgttttgttggttaa

SEQ ID NO: 5197 - DNA, 37 bp, Homo sapiens
  chr17:30250325-30250362
  hypo
taaagctctatattgcgggcagatcgcaaggtcagga

SEQ ID NO: 5198 - DNA, 31 bp, Homo sapiens
  chr17:33877286-33877317
  hypo
aggtgcagtggctcacgcctgtaatcccagc

SEQ ID NO: 5199 - DNA, 146 bp, Homo sapiens; identical to SEQ ID NO: 1618
  chr17:39682499-39682645
  hypo

SEQ ID NO: 5200 - DNA, 102 bp, Homo sapiens; identical to SEQ ID NO: 1619
  chr17:42331669-42331771
  hypo

SEQ ID NO: 5201 - DNA, 120 bp, Homo sapiens; identical to SEQ ID NO: 1620
  chr17:49229470-49229590
  hypo

SEQ ID NO: 5202 - DNA, 34 bp, Homo sapiens
  chr17:55037248-55037282
  hypo
tcatcagaagcatcccgggaaggatgctcgttac

SEQ ID NO: 5203 - DNA, 37 bp, Homo sapiens; identical to SEQ ID NO: 1621
  chr17:57297023-57297060
  hypo

SEQ ID NO: 5204 - DNA, 16 bp, Homo sapiens
  chr17:67410381-67410397
  hypo
gcgagactccctctcg

SEQ ID NO: 5205 - DNA, 19 bp, Homo sapiens
  chr17:73031621-73031640
  hypo
actccagtctctggccggg

SEQ ID NO: 5206 - DNA, 151 bp, Homo sapiens
  chr17:73586267-73586418
  hypo
caagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttat

SEQ ID NO: 5207 - DNA, 54 bp, Homo sapiens
  chr17:73636283-73636337
  hypo
ggctgccaccgacttcgtgcaggagatgcgcgccgtgggcgagaggctgctgct

SEQ ID NO: 5208 - DNA, 292 bp, Homo sapiens
  chr17:76137898-76138190
  hypo
aacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttcc

SEQ ID NO: 5209 - DNA, 31 bp, Homo sapiens; identical to SEQ ID NO: 1623
  chr17:76211256-76211287
  hypo

SEQ ID NO: 5210 - DNA, 91 bp, Homo sapiens; identical to SEQ ID NO: 1624
  chr17:76211527-76211618
  hypo

SEQ ID NO: 5211 - DNA, 309 bp, Homo sapiens; identical to SEQ ID NO: 1625
  chr17:79769384-79769693
  hypo

SEQ ID NO: 5212 - DNA, 67 bp, Homo sapiens; identical to SEQ ID NO: 1626
  chr17:80797692-80797759
  hypo

SEQ ID NO: 5213 - DNA, 723 bp, Homo sapiens; identical to SEQ ID NO: 1627
  chr17:80797997-80798720
  hypo

SEQ ID NO: 5214 - DNA, 290 bp, Homo sapiens
  chr18:10589096-10589386
  hypo
ttctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcg

SEQ ID NO: 5215 - DNA, 72 bp, Homo sapiens
  chr18:55850845-55850917
  hypo
attgagtattcacttcgaagctccatgctgcacgcatgggcctgtaaatagctttttcgtgcacttgtgggt

SEQ ID NO: 5216 - DNA, 30 bp, Homo sapiens; identical to SEQ ID NO: 1628
  chr18:77329727-77329757
  hypo

SEQ ID NO: 5217 - DNA, 405 bp, Homo sapiens
  chr19:403367-403772
  hypo
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacagggtcacacatgcatacacggctcacgtgcttacacgtgcacacgccagcacacaggcagctatactcgagtgcctgcaggcgctcacctggcactgtcacatacgcccaacagatgagcacggtaacggcacacgcagtcacactgcacacacatgcggaagcacatggcgacgtgtgtgcacctacctggcacgcacacgcacacacccgtgcagcctagcgatgagtggctggg

SEQ ID NO: 5218 - DNA, 632 bp, Homo sapiens; identical to SEQ ID NO: 1629
  chr19:883582-884214
  hypo

SEQ ID NO: 5219 - DNA, 460 bp, Homo sapiens; identical to SEQ ID NO: 1630
  chr19:1004981-1005441
  hypo

SEQ ID NO: 5220 - DNA, 298 bp, Homo sapiens
  chr19:1171099-1171397
  hypo
cacaacacacaaacacggatgcacagacacgcacacaatgtgcacccataaaacacacgcgtatgaaacacacgagcaacacacacatgcacaggagcacacagccacaggcacgcacattcacacacacacaacgcacccacatccgtacaacacacacacagaacgcgcacacgtccgtacgacgcacacacagaatgcacgtgcgtacgtacaatgcacacaaagaatacacacatccatacaacacacaggcacacaacacacatgtgcatgcacatggcgcaacatacagata

SEQ ID NO: 5221 - DNA, 261 bp, Homo sapiens; identical to SEQ ID NO: 1631
  chr19:1808152-1808413
  hypo

SEQ ID NO: 5222 - DNA, 109 bp, Homo sapiens
  chr19:2683891-2684000
  hypo
gctggtggacagcatcggccagaggagctcaaatccgccctcagccccagggggccgagctgcaaaagcgacgtcaaatggacaaaaatcccaccgggcacagaagtgc

SEQ ID NO: 5223 - DNA, 91 bp, Homo sapiens
  chr19:3219543-3219634
  hypo
tcccacgcgctttacttcctcagtaacatccatggcacgggcatcctgcagtgaccgatgcccaccagactgcatccgctaacaagacagg

SEQ ID NO: 5224 - DNA, 57 bp, Homo sapiens
  chr19:3296613-3296670
  hypo
cgagggggcctcacccgtgtccgcggcgcccgccgaggcccccgagggcctgcttgg

SEQ ID NO: 5225 - DNA, 194 bp, Homo sapiens
  chr19:3778200-3778394
  hypo
gcgaggtggagccgtcggcgtcctgccctgagacggaggctggggcacctgcactgcgtagctcccgggccagcttctcggccagtttgcggaagggtggccggcgggcgggctctgcctcccagcagctgctcatgaggacgtgcacggggcctggacagccctcggggggttccatgcggtaccccttctcc

SEQ ID NO: 5226 - DNA, 350 bp, Homo sapiens
  chr19:4548034-4548384
  hypo
tcacttcatacaccccgagtactgctggcagcgagccacaggcactcggaccacgcagcgggggaaggcagccagcaggccccccgaagctgcgtccagctccaagctcagcagccgctgccctgtctcgccaccgccgggccgtccacacctggggacaagcagagtggtgaggctgagcgcatctcagcccatctcccctcctgctggcgaccccttcccacctttgcccagacttacctgtccggccggtaggtctcaaactcctccaggaagacactgagcccagacgtccctgaggtgctggcattgggccggacgaggaacttgaggaccgtccccgcctcaga

SEQ ID NO: 5227 - DNA, 216 bp, Homo sapiens; identical to SEQ ID NO: 1632
  chr19:4555896-4556112
  hypo

SEQ ID NO: 5228 - DNA, 85 bp, Homo sapiens
  chr19:4670740-4670825
  hypo
cgaacttctcataatcgttgcagccaagatgtgtgtgcatcgatattcaaaattagcagagggaaagtaggatgagaagcaggat

SEQ ID NO: 5229 - DNA, 102 bp, Homo sapiens
  chr19:5914992-5915094
  hypo
tttgccaagctggaccgcagtggggacggcgtcgtgacggtggacgacctccgcggggtgtacagtggccgtgcccaccccaaggtgcgcagtggggagtgg

SEQ ID NO: 5230 - DNA, 41 bp, Homo sapiens; identical to SEQ ID NO: 1633
  chr19:10231201-10231242
  hypo

SEQ ID NO: 5231 - DNA, 557 bp, Homo sapiens; identical to SEQ ID NO: 1634
  chr19:18989724-18990281
  hypo

SEQ ID NO: 5232 - DNA, 120 bp, Homo sapiens; identical to SEQ ID NO: 1635
  chr19:41881475-41881595
  hypo

SEQ ID NO: 5233 - DNA, 44 bp, Homo sapiens
  chr19:46234843-46234887
  hypo
attacaggcgtgagccaccgcgcccggcccgtcccctcctttct

SEQ ID NO: 5234 - DNA, 411 bp, Homo sapiens
  chr20:401582-401993
  hypo
gaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctg

SEQ ID NO: 5235 - DNA, 43 bp, Homo sapiens
  chr20:799104-799147
  hypo
gagtgaggggtggggcgtagtttcagatttttttttttttttt

SEQ ID NO: 5236 - DNA, 43 bp, Homo sapiens
  chr20:799687-799730
  hypo
gtgccgggatcacaggcgtgagccaccgcgccgggcccagctt

SEQ ID NO: 5237 - DNA, 147 bp, Homo sapiens
  chr20:2113428-2113575
  hypo
caatctaggtttaaacggcagctctcctacttactagctgggcggctttgggcaagtgatctaccttctctgggcccccatttccttgtctggtcagtgcagtaagtgttgctcactgtaggctgtgtccggcgcagttcctagctc

SEQ ID NO: 5238 - DNA, 43 bp, Homo sapiens; identical to SEQ ID NO: 1636
  chr20:3027758-3027801
  hypo

SEQ ID NO: 5239 - DNA, 20 bp, Homo sapiens
  chr20:16554697-16554717
  hypo
taagggagttaaaggcgaac

SEQ ID NO: 5240 - DNA, 139 bp, Homo sapiens
  chr20:16555017-16555156
  hypo
ccaggccgacaactggtatcttaaggcttagggcctctggtagaagtgagctccacctcccttcctgtgtagaaggtaaatgcattcattcattcagtgaatcgagcatgcatgaaatcgtttgcgcacacccagaagc

SEQ ID NO: 5241 - DNA, 20 bp, Homo sapiens
  chr20:25230509-25230529
  hypo
agtcttgccctgtagcgtga

SEQ ID NO: 5242 - DNA, 19 bp, Homo sapiens
  chr20:25230769-25230788
  hypo
ccaacgcacccgacccgca

SEQ ID NO: 5243 - DNA, 153 bp, Homo sapiens
  chr20:30864866-30865019
  hypo
ccgcatgatctgttttaaataattactctggccaccttatggaaaatggattgttcggacagagctggacaaaagaatggaaacagaccagatatttcaggcaggctagagatgagcgtggcctggccttgcctggggcggttgtgactgact

SEQ ID NO: 5244 - DNA, 102 bp, Homo sapiens; identical to SEQ ID NO: 1637
  chr20:42218592-42218694
  hypo

SEQ ID NO: 5245 - DNA, 86 bp, Homo sapiens
  chr20:47905517-47905603
  hypo
accctaaacaagaagcggtatagaccagaatggagcactgattgtaatccaccttctttcttagaaactggcgatggaatatgaga

SEQ ID NO: 5246 - DNA, 343 bp, Homo sapiens; identical to SEQ ID NO: 1638
  chr20:49261761-49262104
  hypo

SEQ ID NO: 5247 - DNA, 68 bp, Homo sapiens
  chr20:49286826-49286894
  hypo
agcaatcttgggcatcggacttggctagaaatccctctcctcctgggaagtctcgtcatcaacaccca

SEQ ID NO: 5248 - DNA, 212 bp, Homo sapiens; identical to SEQ ID NO: 1639
  chr20:49346547-49346759
  hypo

SEQ ID NO: 5249 - DNA, 26 bp, Homo sapiens
  chr20:49350870-49350896
  hypo
aactaggtagtgtgccggtccttttt

SEQ ID NO: 5250 - DNA, 139 bp, Homo sapiens
  chr20:49377921-49378060
  hypo
cgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgct

SEQ ID NO: 5251 - DNA, 157 bp, Homo sapiens
  chr20:60477380-60477537
  hypo
gcccttcaccagccacggagacccggggtctatgggcagtgccctaaatgccagccatgccctggggcacgcggtcaccaccccgcagaaccgctcccgtgctcgttgcaggagtgcaagggcagatccacagaggagcgtgcggggccccaccttc

SEQ ID NO: 5252 - DNA, 463 bp, Homo sapiens
  chr20:61505867-61506330
  hypo
gaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacgg

SEQ ID NO: 5253 - DNA, 66 bp, Homo sapiens
  chr20:62031666-62031732
  hypo
gcaggaccccacacccgaagtcccccgcaaacccgcactggcgcattcttacggctctggcatcaa

SEQ ID NO: 5254 - DNA, 309 bp, Homo sapiens; identical to SEQ ID NO: 1641
  chr20:62046201-62046510
  hypo

SEQ ID NO: 5255 - DNA, 86 bp, Homo sapiens; identical to SEQ ID NO: 1642
  chr20:62115180-62115266
  hypo

SEQ ID NO: 5256 - DNA, 348 bp, Homo sapiens
  chr20:62126081-62126429
  hypo
cacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccg

SEQ ID NO: 5257 - DNA, 247 bp, Homo sapiens
  chr20:62383189-62383436
  hypo
tctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccc

SEQ ID NO: 5258 - DNA, 300 bp, Homo sapiens
  chr21:44866603-44866903
  hypo
cttccctgccacagccggcccagcgggagccaggtcagggcctggagacacagcgccccccaccggagccactgcccggcccagcagcacctgcggagaatcccaccagctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 5259 - DNA, 222 bp, Homo sapiens
  chr21:46036605-46036827
  hypo
gtgagaatgagacaccgtgacaatgcggctgcgcaccggacacctggctcagcgcaggcagcgcacggacagagtctgcggtgtgaccacaccaagcagccctaaggcagcacgtgcccgcacaagcctcagcctctgctccggtcacgcctgcccacttgggtgtattttttgtctgacttttgcttctggggccgaacaacccagcgaattcaacacagc

SEQ ID NO: 5260 - DNA, 349 bp, Homo sapiens
  chr21:46319156-46319505
  hypo
agcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtc

SEQ ID NO: 5261 - DNA, 215 bp, Homo sapiens
  chr21:47746178-47746393
  hypo
gactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggagg

SEQ ID NO: 5262 - DNA, 16 bp, Homo sapiens
  chr22:18110631-18110647
  hypo
acgaccttgtcaaaac

SEQ ID NO: 5263 - DNA, 15 bp, Homo sapiens
  chr22:20864657-20864672
  hypo
cgagactccatctca

SEQ ID NO: 5264 - DNA, 23 bp, Homo sapiens
  chr22:30158368-30158391
  hypo
tgtcaggagctgggccgcacagc

SEQ ID NO: 5265 - DNA, 30 bp, Homo sapiens
  chr22:35079354-35079384
  hypo
ggagctgttcctattcggccatcttggctc

SEQ ID NO: 5266 - DNA, 30 bp, Homo sapiens
  chr22:35768487-35768517
  hypo
caaaaacttcaaggccgggcgcggtggctc

SEQ ID NO: 5267 - DNA, 17 bp, Homo sapiens
  chr22:41839926-41839943
  hypo
gccggaaggtttttcag

SEQ ID NO: 5268 - DNA, 74 bp, Homo sapiens
  chr22:47005080-47005154
  hypo
acatacatcgcagaccgctgagtggcgctggttgctgtctgggccggcttggcctcaggcgatcctgttgccct

SEQ ID NO: 5269 - DNA, 138 bp, Homo sapiens
  chr22:50149332-50149470
  hypo
ccctttccatggcaacgacccataaggtgccacccctttccatggcaacgccccatacggtgccacccctttccatggcaacgccccatacggtgccacccctttacatggcaacgccccatacggtgccatcccttt

SEQ ID NO: 5270 - DNA, 410 bp, Homo sapiens; identical to SEQ ID NO: 1644
  chr22:50899279-50899689
  hypo

SEQ ID NO: 5271 - DNA, 30 bp, Homo sapiens
  chr1:975836-975866
  hyper
gctggcgggaatcctcggcgggcggggtct

SEQ ID NO: 5272 - DNA, 107 bp, Homo sapiens; identical to SEQ ID NO: 1645
  chr1:1475537-1475644
  hyper

SEQ ID NO: 5273 - DNA, 39 bp, Homo sapiens
  chr1:1535851-1535890
  hyper
ggacttcgtgctttacgatgggggcgcagcggtctggca

SEQ ID NO: 5274 - DNA, 30 bp, Homo sapiens
  chr1:1567286-1567316
  hyper
cttcgctcccccctccgaggaccccgccca

SEQ ID NO: 5275 - DNA, 33 bp, Homo sapiens
  chr1:1567781-1567814
  hyper
gggttgggggggtcctcacgtctgtgggtctgg

SEQ ID NO: 5276 - DNA, 37 bp, Homo sapiens
  chr1:1935385-1935422
  hyper
ggaggtcgcgggccccgaggcgcggctgaagggccag

SEQ ID NO: 5277 - DNA, 611 bp, Homo sapiens; identical to SEQ ID NO: 1646
  chr1:2374994-2375605
  hyper

SEQ ID NO: 5278 - DNA, 64 bp, Homo sapiens
  chr1:2560861-2560925
  hyper
cgcttctgccctgcacggccggcgctctccaccatccccactgggccttcggacttccccatca

SEQ ID NO: 5279 - DNA, 30 bp, Homo sapiens
  chr1:2984719-2984749
  hyper
gtgtccccagtggcccgggtccccgaaggt

SEQ ID NO: 5280 - DNA, 30 bp, Homo sapiens
  chr1:2985189-2985219
  hyper
aatgcaggagaaaagcgggccggggcgacg

SEQ ID NO: 5281 - DNA, 42 bp, Homo sapiens
  chr1:2987163-2987205
  hyper
acgccgttccgtccgcgcctccggggccgggtccctccaggc

SEQ ID NO: 5282 - DNA, 69 bp, Homo sapiens
  chr1:3087621-3087690
  hyper
ccccgcacccctcagcgccccacggagacctgcaccttccagactgacagtgctcggggccctctctcc

SEQ ID NO: 5283 - DNA, 85 bp, Homo sapiens
  chr1:3310353-3310438
  hyper
tgcgcggattcccgttcacctctgacccccgaagcagttggaggcaggtcggggacccccgcccccgccccgccccgcctcgggc

SEQ ID NO: 5284 - DNA, 98 bp, Homo sapiens; identical to SEQ ID NO: 1
  chr1:3567247-3567345
  hyper

SEQ ID NO: 5285 - DNA, 114 bp, Homo sapiens; identical to SEQ ID NO: 2
  chr1:3567737-3567851
  hyper

SEQ ID NO: 5286 - DNA, 395 bp, Homo sapiens; identical to SEQ ID NO: 3
  chr1:3567882-3568277
  hyper

SEQ ID NO: 5287 - DNA, 35 bp, Homo sapiens
  chr1:3663252-3663287
  hyper
caggtcggtgaactccgccgcgtagtcgtgtaaag

SEQ ID NO: 5288 - DNA, 271 bp, Homo sapiens
  chr1:3663650-3663921
  hyper
gggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgt

SEQ ID NO: 5289 - DNA, 152 bp, Homo sapiens
  chr1:4712671-4712823
  hyper
aggggttcctggagccgacacggtccggtccggagcccctccctgccctgctggctcctagtgtgcgaagccggccccttccaggcccactccggttgcaggaagggcctccctggtgcagcaccgcctcctcacaccgctaggtggcagca

SEQ ID NO: 5290 - DNA, 31 bp, Homo sapiens
  chr1:4714044-4714075
  hyper
ggttcggggcagaagcgccgaagctccgacc

SEQ ID NO: 5291 - DNA, 113 bp, Homo sapiens; identical to SEQ ID NO: 4
  chr1:4715427-4715540
  hyper

SEQ ID NO: 5292 - DNA, 528 bp, Homo sapiens; identical to SEQ ID NO: 5
  chr1:4715574-4716102
  hyper

SEQ ID NO: 5293 - DNA, 62 bp, Homo sapiens
  chr1:4716475-4716537
  hyper
ggacagaggtggaggcggagagcagcgtgcggttctcgagtttgtccactgggatgcactgc

SEQ ID NO: 5294 - DNA, 126 bp, Homo sapiens
  chr1:4716538-4716664
  hyper
ctcccgcgttggggacgaaaaggccagtagttgttagcccgctgcttgagccgcccccactcagggatgaagctgcggggggagtgaggcgaagggagggaggatctagtgcgtgtcctgattttg

SEQ ID NO: 5295 - DNA, 79 bp, Homo sapiens
  chr1:6208701-6208780
  hyper
tctaggggagtcagacgcggagaagggcgcgaggaagctattgtggacggggtctcgagcagcgcgggcgaagctttgc

SEQ ID NO: 5296 - DNA, 145 bp, Homo sapiens
  chr1:6241066-6241211
  hyper
agaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaag

SEQ ID NO: 5297 - DNA, 188 bp, Homo sapiens
  chr1:6301754-6301942
  hyper
agccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgag

SEQ ID NO: 5298 - DNA, 192 bp, Homo sapiens
  chr1:6304118-6304310
  hyper
gggagcttcccagtgcgtcctccctcggtcccctcctcctcaaggtttctagagtccagagggcctcattgacatgtaaacgagggtccctataaaggcggcgctgcctcgcactggtgcatggactgcaacatgggcacggagcctgctgcccggggcagcctccccggcaacttccgaaaggtctggggt

SEQ ID NO: 5299 - DNA, 763 bp, Homo sapiens
  chr1:6309258-6310021
  hyper
aaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggccca

SEQ ID NO: 5300 - DNA, 517 bp, Homo sapiens; identical to SEQ ID NO: 6
  chr1:6480368-6480885
  hyper

SEQ ID NO: 5301 - DNA, 15 bp, Homo sapiens
  chr1:6500973-6500988
  hyper
ctcactgcgtgcccc

SEQ ID NO: 5302 - DNA, 125 bp, Homo sapiens; identical to SEQ ID NO: 8
  chr1:6501054-6501179
  hyper

SEQ ID NO: 5303 - DNA, 34 bp, Homo sapiens
  chr1:6507490-6507524
  hyper
ggtgtcgcatttcctgcaacgtgagccaggtcgg

SEQ ID NO: 5304 - DNA, 48 bp, Homo sapiens
  chr1:6508019-6508067
  hyper
gggattggcgggccccgggtgatgtcaggccgtcggagcccataggct

SEQ ID NO: 5305 - DNA, 53 bp, Homo sapiens
  chr1:6508969-6509022
  hyper
gaaccatgttcctaacggctgcgccgcggaccccaaggcgtccagggagctgc

SEQ ID NO: 5306 - DNA, 77 bp, Homo sapiens
  chr1:8002422-8002499
  hyper
gccgtcctcctgccccgcggttcccagcacgagctctcccgacagaagaggaaaacgcggcgcgactcggttggggg

SEQ ID NO: 5307 - DNA, 30 bp, Homo sapiens; identical to SEQ ID NO: 9
  chr1:8277113-8277143
  hyper

SEQ ID NO: 5308 - DNA, 48 bp, Homo sapiens
  chr1:9243236-9243284
  hyper
tcagccgaggggccgcggctcagcccccctcaccggccttaaaggttc

SEQ ID NO: 5309 - DNA, 348 bp, Homo sapiens
  chr1:9712291-9712639
  hyper
ggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaa

SEQ ID NO: 5310 - DNA, 140 bp, Homo sapiens
  chr1:9712874-9713014
  hyper
tgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 5311 - DNA, 78 bp, Homo sapiens
  chr1:10057431-10057509
  hyper
ggtctcgggatcaggcgaaggcggccgggccgggcctgtaggtacgtcctctgtccgtgcctccgccctgctgcgccc

SEQ ID NO: 5312 - DNA, 68 bp, Homo sapiens
  chr1:10948552-10948620
  hyper
gcgggaggctccagacgcccagagcccacagcttcccgcccggggcggctgagcggtcccggggagag

SEQ ID NO: 5313 - DNA, 50 bp, Homo sapiens; identical to SEQ ID NO: 10
  chr1:11540129-11540179
  hyper

SEQ ID NO: 5314 - DNA, 61 bp, Homo sapiens
  chr1:11752522-11752583
  hyper
tcagcctggctcccccgacggcgctggtctttcgcctgtggtctcccgctctgtccctcct

SEQ ID NO: 5315 - DNA, 40 bp, Homo sapiens
  chr1:11919143-11919183
  hyper
gtgggaggtggagaccgggcagagccgaccttgtatagaa

SEQ ID NO: 5316 - DNA, 158 bp, Homo sapiens
  chr1:11959080-11959238
  hyper
acctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 5317 - DNA, 133 bp, Homo sapiens; identical to SEQ ID NO: 11
  chr1:12123421-12123554
  hyper

SEQ ID NO: 5318 - DNA, 15 bp, Homo sapiens
  chr1:12123787-12123802
  hyper
cgcaagggaggacac

SEQ ID NO: 5319 - DNA, 134 bp, Homo sapiens
  chr1:13840532-13840666
  hyper
aaggcgtgtcccgggcgtgcgccctgccccctcgcgcccgcctggtgccaaagcacgctccctgcacgccaccctatgtcgccaaagggagtgggacctgggtcactctgactctgctccgggggcaatccctg

SEQ ID NO: 5320 - DNA, 368 bp, Homo sapiens; identical to SEQ ID NO: 1659
  chr1:13910330-13910698
  hyper

SEQ ID NO: 5321 - DNA, 13 bp, Homo sapiens
  chr1:13910699-13910712
  hyper
cgggggagctgag

SEQ ID NO: 5322 - DNA, 30 bp, Homo sapiens
  chr1:14219604-14219634
  hyper
ggagcccagggtcggcgctgcaggcagcgg

SEQ ID NO: 5323 - DNA, 30 bp, Homo sapiens
  chr1:14924607-14924637
  hyper
aggcgggagcaccagcggcccacgccgagg

SEQ ID NO: 5324 - DNA, 142 bp, Homo sapiens
  chr1:14925056-14925198
  hyper
tgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 5325 - DNA, 361 bp, Homo sapiens
  chr1:14925199-14925560
  hyper
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggagg

SEQ ID NO: 5326 - DNA, 127 bp, Homo sapiens; identical to SEQ ID NO: 1661
  chr1:14925923-14926050
  hyper

SEQ ID NO: 5327 - DNA, 80 bp, Homo sapiens
  chr1:16553585-16553665
  hyper
gcaggctcagttcctcggcgtagcacagcggctcccaggcgcgctcagctcggcgaagggtgcggcgctatgccggggta

SEQ ID NO: 5328 - DNA, 30 bp, Homo sapiens
  chr1:16861712-16861742
  hyper
caggccggctgacagcgtagtgaaggaaga

SEQ ID NO: 5329 - DNA, 55 bp, Homo sapiens
  chr1:18436492-18436547
  hyper
gctctccctggaacccgggagcagggttcttctggctgcccggctgcagagagct

SEQ ID NO: 5330 - DNA, 156 bp, Homo sapiens
  chr1:18436827-18436983
  hyper
gcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaa

SEQ ID NO: 5331 - DNA, 229 bp, Homo sapiens; identical to SEQ ID NO: 13
  chr1:18437202-18437431
  hyper

SEQ ID NO: 5332 - DNA, 94 bp, Homo sapiens; identical to SEQ ID NO: 14
  chr1:18437432-18437526
  hyper

SEQ ID NO: 5333 - DNA, 79 bp, Homo sapiens
  chr1:18437738-18437817
  hyper
cccatgcccctccagcgtggccccgcccctagccataaactccacccctcttccaccccataaccgctctgcaaatggg

SEQ ID NO: 5334 - DNA, 30 bp, Homo sapiens
  chr1:18956574-18956604
  hyper
aaggagttataggcccggcctgggggcctg

SEQ ID NO: 5335 - DNA, 476 bp, Homo sapiens; identical to SEQ ID NO: 15
  chr1:18956811-18957287
  hyper

SEQ ID NO: 5336 - DNA, 80 bp, Homo sapiens
  chr1:18957507-18957587
  hyper
gtgtggagggagaagcgagtgtggtccggagaaagaaggcgtggagaagagggagggagcgagagcgagagaataaatat

SEQ ID NO: 5337 - DNA, 219 bp, Homo sapiens
  chr1:18957985-18958204
  hyper
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcct

SEQ ID NO: 5338 - DNA, 58 bp, Homo sapiens
  chr1:18958829-18958887
  hyper
tagagaacctctaaacggcgagaggggcacggcaatgtccaaacgagaagaaagagct

SEQ ID NO: 5339 - DNA, 35 bp, Homo sapiens
  chr1:18959220-18959255
  hyper
tgggctggcagcctgcgatccgggaggagctccct

SEQ ID NO: 5340 - DNA, 123 bp, Homo sapiens
  chr1:18959573-18959696
  hyper
cgactttgcgacgcacgatttctgattaaatccgagagtggcttcagacaccgacttttacaaagagaggtggggggaccgggagagcgagggagggggcggtaggaacggcccagcagcgga

SEQ ID NO: 5341 - DNA, 93 bp, Homo sapiens; identical to SEQ ID NO: 16
  chr1:18960897-18960990
  hyper

SEQ ID NO: 5342 - DNA, 334 bp, Homo sapiens
  chr1:18962827-18963161
  hyper
ggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctacccc

SEQ ID NO: 5343 - DNA, 30 bp, Homo sapiens
  chr1:18963693-18963723
  hyper
gcttttgtttcttgacgggaggaagtttcg

SEQ ID NO: 5344 - DNA, 96 bp, Homo sapiens
  chr1:18964297-18964393
  hyper
tgccgcagtcccgcccgggacaaaagggcgagggaagaaagggagccagctgtgccgggcgccccgctgtgcccggcctgccgaggggccacgggt

SEQ ID NO: 5345 - DNA, 94 bp, Homo sapiens
  chr1:18968003-18968097
  hyper
tggggtcccccgctgcgagggcgtgcgggttttgtgttcccctcggggcacgcaccgccacacttgggctgtttcaaggcgtttgtacctaaaa

SEQ ID NO: 5346 - DNA, 625 bp, Homo sapiens
  chr1:18969533-18970158
  hyper
ctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagat

SEQ ID NO: 5347 - DNA, 30 bp, Homo sapiens
  chr1:18970361-18970391
  hyper
ttctgcgctccaacccggggcgctgggcag

SEQ ID NO: 5348 - DNA, 64 bp, Homo sapiens
  chr1:18971750-18971814
  hyper
gcttcgccacgggttcgagggagaggcggagggaggagcggctgggctgcggagcctcttgcct

SEQ ID NO: 5349 - DNA, 29 bp, Homo sapiens
  chr1:19043114-19043143
  hyper
cgtctccctgatcgcgtcataaccctgag

SEQ ID NO: 5350 - DNA, 287 bp, Homo sapiens
  chr1:19043456-19043743
  hyper
gggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactg

SEQ ID NO: 5351 - DNA, 151 bp, Homo sapiens
  chr1:19043756-19043907
  hyper
cgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcat

SEQ ID NO: 5352 - DNA, 276 bp, Homo sapiens
  chr1:20618169-20618445
  hyper
atgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagcagcgggtgcagtgtggcgcctgctaacgcatcaagcctccgctggaagttccaccataacgtctgcggcagccccaacagttccaccccatgctcccgccgccggcaccacagcagc

SEQ ID NO: 5353 - DNA, 72 bp, Homo sapiens
  chr1:20669776-20669848
  hyper
cggcgcgcaggatgccgacctatggagcgagaccttccaccacctggcggcccgcgccatcatccgcgactt

SEQ ID NO: 5354 - DNA, 40 bp, Homo sapiens
  chr1:20692819-20692859
  hyper
gtcggtccccactcccgacgggcctcgcattcctggtcct

SEQ ID NO: 5355 - DNA, 55 bp, Homo sapiens
  chr1:20810635-20810690
  hyper
aggtgcggagatgagcggaaccaggaggggacgccaaaaccggttcccacgacgc

SEQ ID NO: 5356 - DNA, 92 bp, Homo sapiens
  chr1:20878524-20878616
  hyper
cagcggtctggcccacgaccttggaagaacctgggagaaagcttcaccaagcgacagtacttttccactgcactgctcggccacctcggctg

SEQ ID NO: 5357 - DNA, 124 bp, Homo sapiens
  chr1:20878905-20879029
  hyper
gcctgtgcagggtcccgggcagcgcgagcctgcgtggggggaggggagaagagggcaaggggaggggacaagagagctagcggtcccgcccggtgatgtaggcagcccggggaggtggagccgc

SEQ ID NO: 5358 - DNA, 199 bp, Homo sapiens
  chr1:20879030-20879229
  hyper
acgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaag

SEQ ID NO: 5359 - DNA, 182 bp, Homo sapiens
  chr1:20879255-20879437
  hyper
cgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctg

SEQ ID NO: 5360 - DNA, 169 bp, Homo sapiens
  chr1:20879462-20879631
  hyper
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtg

SEQ ID NO: 5361 - DNA, 760 bp, Homo sapiens
  chr1:20879845-20880605
  hyper
gcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggct

SEQ ID NO: 5362 - DNA, 79 bp, Homo sapiens
  chr1:21044125-21044204
  hyper
tggcagcgcagctctcgctcccgctggttcatgggacggcagcgcacgacaaccttcaccgcctcggaggccatggcgc

SEQ ID NO: 5363 - DNA, 102 bp, Homo sapiens
  chr1:21754482-21754584
  hyper
ggggggcgttctcggcgcggagtggagtggagcggagcgggctggtgctgggggcgcggagagcgcagtgctggccggggccgggagcggggccgagcggga

SEQ ID NO: 5364 - DNA, 42 bp, Homo sapiens
  chr1:21835408-21835450
  hyper
agagagacagggacacgtgggcagagacggataaagacagag

SEQ ID NO: 5365 - DNA, 50 bp, Homo sapiens
  chr1:21836105-21836155
  hyper
ctttaatggcagggccggggtctccagcgccacgccgcccacagcagccc

SEQ ID NO: 5366 - DNA, 331 bp, Homo sapiens; identical to SEQ ID NO: 17
  chr1:22140683-22141014
  hyper

SEQ ID NO: 5367 - DNA, 287 bp, Homo sapiens; identical to SEQ ID NO: 18
  chr1:22141015-22141302
  hyper

SEQ ID NO: 5368 - DNA, 30 bp, Homo sapiens
  chr1:22933907-22933937
  hyper
ttctgctgccacctccgcttccctcagcga

SEQ ID NO: 5369 - DNA, 255 bp, Homo sapiens
  chr1:23748862-23749117
  hyper
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccat

SEQ ID NO: 5370 - DNA, 812 bp, Homo sapiens
  chr1:25256012-25256824
  hyper
ctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 5371 - DNA, 37 bp, Homo sapiens
  chr1:25257156-25257193
  hyper
gggcctgtgacttctgcaaccccgggctgggggccgc

SEQ ID NO: 5372 - DNA, 106 bp, Homo sapiens
  chr1:26372988-26373094
  hyper
agaggctactggggccgcgtctgccccctccgactggcggctgccctgggcttgatcatgttcccctctcaggccggagaccccccgaggtcggcttgcgttcctg

SEQ ID NO: 5373 - DNA, 312 bp, Homo sapiens
  chr1:26551804-26552116
  hyper
caaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatc

SEQ ID NO: 5374 - DNA, 309 bp, Homo sapiens
  chr1:26735645-26735954
  hyper
tcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgt

SEQ ID NO: 5375 - DNA, 400 bp, Homo sapiens
  chr1:26737246-26737646
  hyper
cgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctggga

SEQ ID NO: 5376 - DNA, 82 bp, Homo sapiens
  chr1:26738220-26738302
  hyper
ccctgttaactatctcgtgggggagtagtgggaggcagcaccaattatcagcacccccgcccccttccgggaacccctccgg

SEQ ID NO: 5377 - DNA, 138 bp, Homo sapiens
  chr1:28199339-28199477
  hyper
ctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagc

SEQ ID NO: 5378 - DNA, 52 bp, Homo sapiens
  chr1:29138840-29138892
  hyper
tccccgcgcccagggcgcacggtggagagggacgcggcggagccggccggca

SEQ ID NO: 5379 - DNA, 164 bp, Homo sapiens
  chr1:29448530-29448694
  hyper
cgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggt

SEQ ID NO: 5380 - DNA, 425 bp, Homo sapiens; identical to SEQ ID NO: 1668
  chr1:29586066-29586491
  hyper

SEQ ID NO: 5381 - DNA, 30 bp, Homo sapiens
  chr1:29805064-29805094
  hyper
cctcgcggtgagggtcgctcctgggtgtgg

SEQ ID NO: 5382 - DNA, 108 bp, Homo sapiens
  chr1:30559030-30559138
  hyper
ggaggtcccgggggccgccccgcctcgcagcctgggctctgcctgctctgcgtccacgccagcataagccccagccggctccgtctcccctaacgactctaattacca

SEQ ID NO: 5383 - DNA, 124 bp, Homo sapiens; identical to SEQ ID NO: 1669
  chr1:30815454-30815578
  hyper

SEQ ID NO: 5384 - DNA, 230 bp, Homo sapiens
  chr1:32180184-32180414
  hyper
actcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtgggcacgttcctgcgccccg

SEQ ID NO: 5385 - DNA, 228 bp, Homo sapiens
  chr1:32180905-32181133
  hyper
cgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggac

SEQ ID NO: 5386 - DNA, 15 bp, Homo sapiens
  chr1:32237531-32237546
  hyper
cccaccgccggaagc

SEQ ID NO: 5387 - DNA, 1008 bp, Homo sapiens; identical to SEQ ID NO: 20
  chr1:32237638-32238646
  hyper

SEQ ID NO: 5388 - DNA, 130 bp, Homo sapiens
  chr1:32410234-32410364
  hyper
ctagagcttcccctgcgtccgcctttgggggaggggagggagtgaagctgtgaattccgggagaagtcaagggtcgctcggggcgtgggtccgcgcgcggaggggctcgctgtcccggtgccagcgggag

SEQ ID NO: 5389 - DNA, 16 bp, Homo sapiens
  chr1:32827808-32827824
  hyper
ggcctctggccatggc

SEQ ID NO: 5390 - DNA, 240 bp, Homo sapiens
  chr1:32930682-32930922
  hyper
tgcgctgctggaacccgctggaaggtgagcgcgaagaagcgggttggcgctgccgctttcgttggtttggggaggattcctagcacccgggaggctggctggagattggggttagcgggcagggttgcccccactcagtcatcctccttcggaccgcttggccctggcaactcctgggacctccgccccgcgagcccttctagcgtggggaggggcaggcgcggccgtggggccccagct

SEQ ID NO: 5391 - DNA, 35 bp, Homo sapiens
  chr1:33351678-33351713
  hyper
tgccaattcggccctcgaagcgacgtgcggctcag

SEQ ID NO: 5392 - DNA, 30 bp, Homo sapiens
  chr1:33772555-33772585
  hyper
ccagtccaggccccccgcacagtgcgccgt

SEQ ID NO: 5393 - DNA, 985 bp, Homo sapiens
  chr1:34628827-34629812
  hyper
cagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaaccccc

SEQ ID NO: 5394 - DNA, 741 bp, Homo sapiens; identical to SEQ ID NO: 1672
  chr1:34630245-34630986
  hyper

SEQ ID NO: 5395 - DNA, 30 bp, Homo sapiens
  chr1:34631535-34631565
  hyper
tcatttgacccagtgcggtcccactcctac

SEQ ID NO: 5396 - DNA, 192 bp, Homo sapiens
  chr1:34632140-34632332
  hyper
caagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattgggg

SEQ ID NO: 5397 - DNA, 21 bp, Homo sapiens
  chr1:34642862-34642883
  hyper
gctctgcgaggggctccctgg

SEQ ID NO: 5398 - DNA, 136 bp, Homo sapiens
  chr1:35258578-35258714
  hyper
cccccgccgctcgtgcggtccagcagggctcccgcgggcgtcactccggccatcgtccccacctccacctgggccgcccggcaggcaggcggtgagtcgggggctaggaagggaccaggggcgccacctgctcgcg

SEQ ID NO: 5399 - DNA, 720 bp, Homo sapiens
  chr1:35351039-35351759
  hyper
cagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggccc

SEQ ID NO: 5400 - DNA, 60 bp, Homo sapiens
  chr1:35390613-35390673
  hyper
atcccactcagcacccgggacagttcccagcgacattgccggccccggtagccagaaacc

SEQ ID NO: 5401 - DNA, 16 bp, Homo sapiens
  chr1:35395525-35395541
  hyper
ccaggaacaggcaccc

SEQ ID NO: 5402 - DNA, 207 bp, Homo sapiens
  chr1:35395542-35395749
  hyper
aagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagct

SEQ ID NO: 5403 - DNA, 36 bp, Homo sapiens
  chr1:35395964-35396000
  hyper
gggattgtgccatggcggggtcggggtggggggaaa

SEQ ID NO: 5404 - DNA, 940 bp, Homo sapiens; identical to SEQ ID NO: 21
  chr1:36042549-36043489
  hyper

SEQ ID NO: 5405 - DNA, 30 bp, Homo sapiens
  chr1:36549840-36549870
  hyper
aagaaaggggtttgacggggaaccggactg

SEQ ID NO: 5406 - DNA, 92 bp, Homo sapiens; identical to SEQ ID NO: 1674
  chr1:37498753-37498845
  hyper

SEQ ID NO: 5407 - DNA, 200 bp, Homo sapiens; identical to SEQ ID NO: 1675
  chr1:37498888-37499088
  hyper

SEQ ID NO: 5408 - DNA, 223 bp, Homo sapiens; identical to SEQ ID NO: 1676
  chr1:37499460-37499683
  hyper

SEQ ID NO: 5409 - DNA, 142 bp, Homo sapiens; identical to SEQ ID NO: 1677
  chr1:37500013-37500155
  hyper

SEQ ID NO: 5410 - DNA, 67 bp, Homo sapiens
  chr1:37500508-37500575
  hyper
gcccgccgggagcagcgagaccgggagcccgccgtctgcggagcctggcctcgcggctcccacgcgg

SEQ ID NO: 5411 - DNA, 204 bp, Homo sapiens
  chr1:37500602-37500806
  hyper
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggg

SEQ ID NO: 5412 - DNA, 188 bp, Homo sapiens
  chr1:38219712-38219900
  hyper
ggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagcc

SEQ ID NO: 5413 - DNA, 155 bp, Homo sapiens
  chr1:38230088-38230243
  hyper
cccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 5414 - DNA, 3 bp, Homo sapiens
  chr1:38230282-38230285
  hyper
cgc

SEQ ID NO: 5415 - DNA, 218 bp, Homo sapiens
  chr1:38230623-38230841
  hyper
tcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtct

SEQ ID NO: 5416 - DNA, 162 bp, Homo sapiens; identical to SEQ ID NO: 22
  chr1:38510087-38510249
  hyper

SEQ ID NO: 5417 - DNA, 425 bp, Homo sapiens; identical to SEQ ID NO: 23
  chr1:38510309-38510734
  hyper

SEQ ID NO: 5418 - DNA, 160 bp, Homo sapiens; identical to SEQ ID NO: 24
  chr1:38510773-38510933
  hyper

SEQ ID NO: 5419 - DNA, 866 bp, Homo sapiens; identical to SEQ ID NO: 25
  chr1:38510934-38511800
  hyper

SEQ ID NO: 5420 - DNA, 269 bp, Homo sapiens; identical to SEQ ID NO: 26
  chr1:38511821-38512090
  hyper

SEQ ID NO: 5421 - DNA, 64 bp, Homo sapiens
  chr1:39044122-39044186
  hyper
acggggaccgggagacgcgatccggagagcggtgggaagtattcgcctccgttcctcaaacaca

SEQ ID NO: 5422 - DNA, 478 bp, Homo sapiens; identical to SEQ ID NO: 1683
  chr1:39269643-39270121
  hyper

SEQ ID NO: 5423 - DNA, 165 bp, Homo sapiens
  chr1:40105139-40105304
  hyper
cctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaac

SEQ ID NO: 5424 - DNA, 79 bp, Homo sapiens
  chr1:40105538-40105617
  hyper
tctgctccgctgtctcggctgccgcgcgctgggtggccttgggcaggtgccctgggaggccccgcggggaagccaggag

SEQ ID NO: 5425 - DNA, 120 bp, Homo sapiens; identical to SEQ ID NO: 1684
  chr1:40237083-40237203
  hyper

SEQ ID NO: 5426 - DNA, 173 bp, Homo sapiens
  chr1:40781428-40781601
  hyper
ggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatg

SEQ ID NO: 5427 - DNA, 91 bp, Homo sapiens
  chr1:41267904-41267995
  hyper
tgtgaggtggaagggcgaggccgaggcggcggtggcgtcgcgtcccccctctccgcccctggcctcggggacgcggcggcaccttcacact

SEQ ID NO: 5428 - DNA, 428 bp, Homo sapiens; identical to SEQ ID NO: 1685
  chr1:41284168-41284596
  hyper

SEQ ID NO: 5429 - DNA, 30 bp, Homo sapiens
  chr1:41327007-41327037
  hyper
gtctctttcactttacggccgaggctgggg

SEQ ID NO: 5430 - DNA, 9 bp, Homo sapiens
  chr1:41350136-41350145
  hyper
cgcgctcac

SEQ ID NO: 5431 - DNA, 414 bp, Homo sapiens
  chr1:41847478-41847892
  hyper
gcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcc

SEQ ID NO: 5432 - DNA, 11 bp, Homo sapiens
  chr1:43533901-43533912
  hyper
ggtgtgcgccc

SEQ ID NO: 5433 - DNA, 30 bp, Homo sapiens
  chr1:43534162-43534192
  hyper
aggcggcctctgtgccgacccagctgattc

SEQ ID NO: 5434 - DNA, 141 bp, Homo sapiens; identical to SEQ ID NO: 27
  chr1:44872582-44872723
  hyper

SEQ ID NO: 5435 - DNA, 141 bp, Homo sapiens; identical to SEQ ID NO: 28
  chr1:44872923-44873064
  hyper

SEQ ID NO: 5436 - DNA, 108 bp, Homo sapiens; identical to SEQ ID NO: 29
  chr1:44873065-44873173
  hyper

SEQ ID NO: 5437 - DNA, 281 bp, Homo sapiens; identical to SEQ ID NO: 30
  chr1:44873509-44873790
  hyper

SEQ ID NO: 5438 - DNA, 94 bp, Homo sapiens; identical to SEQ ID NO: 31
  chr1:44883121-44883215
  hyper

SEQ ID NO: 5439 - DNA, 95 bp, Homo sapiens; identical to SEQ ID NO: 32
  chr1:44883751-44883846
  hyper

SEQ ID NO: 5440 - DNA, 15 bp, Homo sapiens
  chr1:44884108-44884123
  hyper
cgaagtccagggctc

SEQ ID NO: 5441 - DNA, 91 bp, Homo sapiens
  chr1:45250257-45250348
  hyper
cgaggacccgcgtgccgggtcaggcccagtgcaagccactcaccgcaggttgaaggtggagcccaggaatgagggccgcagagactcggcc

SEQ ID NO: 5442 - DNA, 32 bp, Homo sapiens
  chr1:45252161-45252193
  hyper
ggaagcgcttaagcacgcgggtgctgaccgag

SEQ ID NO: 5443 - DNA, 181 bp, Homo sapiens
  chr1:46632764-46632945
  hyper
gctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctg

SEQ ID NO: 5444 - DNA, 40 bp, Homo sapiens; identical to SEQ ID NO: 1692
  chr1:46913837-46913877
  hyper

SEQ ID NO: 5445 - DNA, 360 bp, Homo sapiens; identical to SEQ ID NO: 1693
  chr1:46913886-46914246
  hyper

SEQ ID NO: 5446 - DNA, 137 bp, Homo sapiens; identical to SEQ ID NO: 1694
  chr1:46914285-46914422
  hyper

SEQ ID NO: 5447 - DNA, 122 bp, Homo sapiens; identical to SEQ ID NO: 1695
  chr1:46951196-46951318
  hyper

SEQ ID NO: 5448 - DNA, 95 bp, Homo sapiens; identical to SEQ ID NO: 1696
  chr1:46951644-46951739
  hyper

SEQ ID NO: 5449 - DNA, 229 bp, Homo sapiens; identical to SEQ ID NO: 33
  chr1:46956387-46956616
  hyper

SEQ ID NO: 5450 - DNA, 155 bp, Homo sapiens; identical to SEQ ID NO: 34
  chr1:46956684-46956839
  hyper

SEQ ID NO: 5451 - DNA, 314 bp, Homo sapiens; identical to SEQ ID NO: 35
  chr1:46956840-46957154
  hyper

SEQ ID NO: 5452 - DNA, 326 bp, Homo sapiens; identical to SEQ ID NO: 36
  chr1:47009560-47009886
  hyper

SEQ ID NO: 5453 - DNA, 126 bp, Homo sapiens; identical to SEQ ID NO: 37
  chr1:47009910-47010036
  hyper

SEQ ID NO: 5454 - DNA, 28 bp, Homo sapiens
  chr1:47010104-47010132
  hyper
cgtccgcactttccgagagccaggcacg

SEQ ID NO: 5455 - DNA, 30 bp, Homo sapiens
  chr1:47695212-47695242
  hyper
cctcctccccccacccgccttaaaaaaccc

SEQ ID NO: 5456 - DNA, 30 bp, Homo sapiens
  chr1:47695896-47695926
  hyper
aggtaaaaacaaacccgacactactttcaa

SEQ ID NO: 5457 - DNA, 226 bp, Homo sapiens; identical to SEQ ID NO: 39
  chr1:47696295-47696521
  hyper

SEQ ID NO: 5458 - DNA, 345 bp, Homo sapiens; identical to SEQ ID NO: 40
  chr1:47696620-47696965
  hyper

SEQ ID NO: 5459 - DNA, 44 bp, Homo sapiens; identical to SEQ ID NO: 41
  chr1:47696986-47697030
  hyper

SEQ ID NO: 5460 - DNA, 606 bp, Homo sapiens; identical to SEQ ID NO: 42
  chr1:47697341-47697947
  hyper

SEQ ID NO: 5461 - DNA, 89 bp, Homo sapiens; identical to SEQ ID NO: 43
  chr1:47698006-47698095
  hyper

SEQ ID NO: 5462 - DNA, 55 bp, Homo sapiens
  chr1:47882051-47882106
  hyper
tcgcgccgtcggggccgccgccgtcgccgctcgcaggagccgagccagggcggga

SEQ ID NO: 5463 - DNA, 34 bp, Homo sapiens
  chr1:47882769-47882803
  hyper
ctactcgcaggtccccgaccgcctggtactgccc

SEQ ID NO: 5464 - DNA, 370 bp, Homo sapiens; identical to SEQ ID NO: 1708
  chr1:47909575-47909945
  hyper

SEQ ID NO: 5465 - DNA, 86 bp, Homo sapiens
  chr1:47910539-47910625
  hyper
gctcgaggctgaggccgctccggaggcctggaggcttcggactgctggactagtggggaaggaaggcggtttcctccgcagcgccc

SEQ ID NO: 5466 - DNA, 127 bp, Homo sapiens
  chr1:47910748-47910875
  hyper
cgctcgctgtccgcgactttgcatttctcctgcagcaggggtctctacccggtgccttcctcccggcacgctagcctcctcgccgaaatttcgtcgtcccggagtcggtaaccgagtcccaggcttt

SEQ ID NO: 5467 - DNA, 222 bp, Homo sapiens; identical to SEQ ID NO: 1709
  chr1:48059057-48059279
  hyper

SEQ ID NO: 5468 - DNA, 52 bp, Homo sapiens
  chr1:48191010-48191062
  hyper
aaagtcaatattggccgcggcgcccgcccggggcacccgggagcccctctgg

SEQ ID NO: 5469 - DNA, 79 bp, Homo sapiens
  chr1:48462159-48462238
  hyper
gggagcgccccttctcgctcctggctgggagctggagccgggacaggcaggagcgaaggaagggcgcccgaggctgcgc

SEQ ID NO: 5470 - DNA, 16 bp, Homo sapiens
  chr1:49242343-49242359
  hyper
ggctctcgggcccggc

SEQ ID NO: 5471 - DNA, 151 bp, Homo sapiens
  chr1:49242360-49242511
  hyper
cccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcg

SEQ ID NO: 5472 - DNA, 64 bp, Homo sapiens
  chr1:49242884-49242948
  hyper
attgattaaaaggtgcgctgcgtgcaggattatattgcttcaacaatcgcgctgccaaattgca

SEQ ID NO: 5473 - DNA, 218 bp, Homo sapiens
  chr1:50513693-50513911
  hyper
agggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacgg

SEQ ID NO: 5474 - DNA, 34 bp, Homo sapiens
  chr1:50514141-50514175
  hyper
tgaaacttgggttgacgcgcgccccctccccagc

SEQ ID NO: 5475 - DNA, 665 bp, Homo sapiens; identical to SEQ ID NO: 1710
  chr1:50798652-50799317
  hyper

SEQ ID NO: 5476 - DNA, 127 bp, Homo sapiens; identical to SEQ ID NO: 1711
  chr1:50799393-50799520
  hyper

SEQ ID NO: 5477 - DNA, 302 bp, Homo sapiens; identical to SEQ ID NO: 1712
  chr1:50880931-50881233
  hyper

SEQ ID NO: 5478 - DNA, 65 bp, Homo sapiens
  chr1:50881486-50881551
  hyper
acctcactcctagaacgcccaccgctcacgaagccttcctgagctctacccgaaggtgctgacag

SEQ ID NO: 5479 - DNA, 88 bp, Homo sapiens; identical to SEQ ID NO: 1713
  chr1:50881869-50881957
  hyper

SEQ ID NO: 5480 - DNA, 119 bp, Homo sapiens; identical to SEQ ID NO: 1714
  chr1:50882143-50882262
  hyper

SEQ ID NO: 5481 - DNA, 59 bp, Homo sapiens
  chr1:50882470-50882529
  hyper
gtcgccggacccagccgaggggaggagtcattcttttcctggagcgggggagtcaccct

SEQ ID NO: 5482 - DNA, 600 bp, Homo sapiens; identical to SEQ ID NO: 44
  chr1:50882808-50883408
  hyper

SEQ ID NO: 5483 - DNA, 15 bp, Homo sapiens
  chr1:50883962-50883977
  hyper
ccatccactgagagc

SEQ ID NO: 5484 - DNA, 333 bp, Homo sapiens; identical to SEQ ID NO: 46
  chr1:50884020-50884353
  hyper

SEQ ID NO: 5485 - DNA, 198 bp, Homo sapiens; identical to SEQ ID NO: 47
  chr1:50884690-50884888
  hyper

SEQ ID NO: 5486 - DNA, 131 bp, Homo sapiens
  chr1:50886104-50886235
  hyper
aaaccagggagggtgcggaagaaactagaaggagggagggcgcagcaagcggttgtccagagggcgttaggaacgcgagaaggggaaaagaaactagggcgtctcagaacctagggcgtctcaaaacctag

SEQ ID NO: 5487 - DNA, 634 bp, Homo sapiens; identical to SEQ ID NO: 48
  chr1:50886451-50887085
  hyper

SEQ ID NO: 5488 - DNA, 60 bp, Homo sapiens; identical to SEQ ID NO: 49
  chr1:50887175-50887235
  hyper

SEQ ID NO: 5489 - DNA, 30 bp, Homo sapiens
  chr1:50888238-50888268
  hyper
agtcggggcggaagacgtatcctgcgaaaa

SEQ ID NO: 5490 - DNA, 121 bp, Homo sapiens
  chr1:50888675-50888796
  hyper
ctctcccagacccttcgggcgtccctaaggcccacggggcccaggcctcctcaacaggggccgcagaccaggtctccacccactgctctccctgcggccctcaactacctgccttgggctc

SEQ ID NO: 5491 - DNA, 727 bp, Homo sapiens; identical to SEQ ID NO: 1721
  chr1:50889123-50889850
  hyper

SEQ ID NO: 5492 - DNA, 307 bp, Homo sapiens; identical to SEQ ID NO: 1722
  chr1:50890061-50890368
  hyper

SEQ ID NO: 5493 - DNA, 152 bp, Homo sapiens; identical to SEQ ID NO: 1723
  chr1:50890795-50890947
  hyper

SEQ ID NO: 5494 - DNA, 322 bp, Homo sapiens; identical to SEQ ID NO: 50
  chr1:50891148-50891470
  hyper

SEQ ID NO: 5495 - DNA, 131 bp, Homo sapiens; identical to SEQ ID NO: 1725
  chr1:50892153-50892284
  hyper

SEQ ID NO: 5496 - DNA, 525 bp, Homo sapiens; identical to SEQ ID NO: 1726
  chr1:50892336-50892861
  hyper

SEQ ID NO: 5497 - DNA, 2 bp, Homo sapiens
  chr1:50893147-50893149
  hyper
cc

SEQ ID NO: 5498 - DNA, 273 bp, Homo sapiens
  chr1:50893150-50893423
  hyper
tggtcatagccacggatctatgccacgacctgggaccgggcataatttcggagccagaaagtactcctgtggtggcgccgggtttctcaggcgctcttccagctaagggccaggagcccagcgatttccctacagttgcttactgaagtcgcaccattctctgcgaggcaggtccgattattccacttgtcaggtgagaaaacagactcggagaggtgagatgacttgttccacattatcacaattagtgagtaacagtgcaaaaatcaaacc

SEQ ID NO: 5499 - DNA, 298 bp, Homo sapiens
  chr1:50893518-50893816
  hyper
cgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgt

SEQ ID NO: 5500 - DNA, 248 bp, Homo sapiens
  chr1:53068182-53068430
  hyper
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacg

SEQ ID NO: 5501 - DNA, 351 bp, Homo sapiens
  chr1:53098702-53099053
  hyper
tcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 5502 - DNA, 312 bp, Homo sapiens
  chr1:53099054-53099366
  hyper
tctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 5503 - DNA, 52 bp, Homo sapiens
  chr1:53168843-53168895
  hyper
gggggctgcccagctcgccgtcctctgcagatcccctcgggactctcagcat

SEQ ID NO: 5504 - DNA, 49 bp, Homo sapiens; identical to SEQ ID NO: 1727
  chr1:53308559-53308608
  hyper

SEQ ID NO: 5505 - DNA, 368 bp, Homo sapiens; identical to SEQ ID NO: 1728
  chr1:53308907-53309275
  hyper

SEQ ID NO: 5506 - DNA, 30 bp, Homo sapiens
  chr1:53527576-53527606
  hyper
gcggaccagacagcccgccttcccggtctc

SEQ ID NO: 5507 - DNA, 92 bp, Homo sapiens
  chr1:53527939-53528031
  hyper
gttcggcctgtggggcgccgctcggcgccggggcgcagcaggtacagggcgctggcagccggggtgggccgaggggccgggggctgagcccg

SEQ ID NO: 5508 - DNA, 184 bp, Homo sapiens
  chr1:53528255-53528439
  hyper
gaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctcca

SEQ ID NO: 5509 - DNA, 504 bp, Homo sapiens; identical to SEQ ID NO: 51
  chr1:54203828-54204332
  hyper

SEQ ID NO: 5510 - DNA, 135 bp, Homo sapiens
  chr1:55462748-55462883
  hyper
caggctcggtttcctcgcctgtgaaatgcgggcgatgactcccctccccgccgcgactgctcatcaccgggtccgagcccagccgctgaccccgggggaagcgccttgctcagcgccgggcggcccacgaggccc

SEQ ID NO: 5511 - DNA, 30 bp, Homo sapiens
  chr1:57111203-57111233
  hyper
ggccgaggggagaggcgggagccccgggcc

SEQ ID NO: 5512 - DNA, 70 bp, Homo sapiens
  chr1:57888327-57888397
  hyper
ctctcccagcctaagcggaagtgccccagcagacccccaacaatgaggatttgtgcgatgcagttggggg

SEQ ID NO: 5513 - DNA, 255 bp, Homo sapiens
  chr1:57888780-57889035
  hyper
gcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcac

SEQ ID NO: 5514 - DNA, 67 bp, Homo sapiens
  chr1:57889036-57889103
  hyper
gtgcccgcgaaagggctgggattactgggatagagtcggtttttcgagaggtcgaagccgaatctca

SEQ ID NO: 5515 - DNA, 126 bp, Homo sapiens
  chr1:57889478-57889604
  hyper
ccaggagccctcctccgcgccccggggctccagcgaagcctcctggctccccggcgccctgtcctcgcggggcacctgcggcgctgaactcaagggttgccgcgcgcccccgccgcgcctcacctc

SEQ ID NO: 5516 - DNA, 329 bp, Homo sapiens
  chr1:57889605-57889934
  hyper
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccgggg

SEQ ID NO: 5517 - DNA, 218 bp, Homo sapiens
  chr1:57890367-57890585
  hyper
gcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 5518 - DNA, 29 bp, Homo sapiens
  chr1:58715503-58715532
  hyper
cggccacaacttgggcggctctgtgcggc

SEQ ID NO: 5519 - DNA, 322 bp, Homo sapiens; identical to SEQ ID NO: 53
  chr1:58715533-58715855
  hyper

SEQ ID NO: 5520 - DNA, 15 bp, Homo sapiens
  chr1:58715978-58715993
  hyper
cgagcgggctccgct

SEQ ID NO: 5521 - DNA, 400 bp, Homo sapiens
  chr1:59042095-59042495
  hyper
gcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggcc

SEQ ID NO: 5522 - DNA, 30 bp, Homo sapiens
  chr1:62784565-62784595
  hyper
gctgggaggcgggggcgccaggtcggccca

SEQ ID NO: 5523 - DNA, 256 bp, Homo sapiens
  chr1:62784890-62785146
  hyper
cccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgt

SEQ ID NO: 5524 - DNA, 342 bp, Homo sapiens; identical to SEQ ID NO: 55
  chr1:63539509-63539851
  hyper

SEQ ID NO: 5525 - DNA, 32 bp, Homo sapiens
  chr1:63784373-63784405
  hyper
actcttggtgggggacgcgcccttcactccgc

SEQ ID NO: 5526 - DNA, 306 bp, Homo sapiens; identical to SEQ ID NO: 56
  chr1:63784987-63785293
  hyper

SEQ ID NO: 5527 - DNA, 149 bp, Homo sapiens; identical to SEQ ID NO: 57
  chr1:63785618-63785767
  hyper

SEQ ID NO: 5528 - DNA, 251 bp, Homo sapiens; identical to SEQ ID NO: 58
  chr1:63786078-63786329
  hyper

SEQ ID NO: 5529 - DNA, 102 bp, Homo sapiens; identical to SEQ ID NO: 1737
  chr1:63786656-63786758
  hyper

SEQ ID NO: 5530 - DNA, 32 bp, Homo sapiens; identical to SEQ ID NO: 1738
  chr1:63787031-63787063
  hyper

SEQ ID NO: 5531 - DNA, 308 bp, Homo sapiens
  chr1:63787302-63787610
  hyper
caccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggt

SEQ ID NO: 5532 - DNA, 315 bp, Homo sapiens
  chr1:63788359-63788674
  hyper
cctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccga

SEQ ID NO: 5533 - DNA, 280 bp, Homo sapiens; identical to SEQ ID NO: 59
  chr1:63789217-63789497
  hyper

SEQ ID NO: 5534 - DNA, 31 bp, Homo sapiens; identical to SEQ ID NO: 60
  chr1:63789728-63789759
  hyper

SEQ ID NO: 5535 - DNA, 26 bp, Homo sapiens
  chr1:63790252-63790278
  hyper
ggtcccggtcccgctgcccaatcctg

SEQ ID NO: 5536 - DNA, 15 bp, Homo sapiens
  chr1:63792634-63792649
  hyper
ccaccgccggagact

SEQ ID NO: 5537 - DNA, 87 bp, Homo sapiens
  chr1:63792797-63792884
  hyper
cggacccagaccctcaagctgccagcggttgtttaaagtcctggcagatgtcaggaagatgggcccggccgtcgcaccctcaaaagc

SEQ ID NO: 5538 - DNA, 584 bp, Homo sapiens; identical to SEQ ID NO: 61
  chr1:63795350-63795934
  hyper

SEQ ID NO: 5539 - DNA, 218 bp, Homo sapiens; identical to SEQ ID NO: 62
  chr1:63795935-63796153
  hyper

SEQ ID NO: 5540 - DNA, 275 bp, Homo sapiens
  chr1:65731231-65731506
  hyper
gggggaagagagaaacgaatttaaataaaaactcaaaaaaggaaagggctaaccgaaaaatgagccaaccaaattttaagttcaacaacaagcattctggaggattctggggttttaaattcggaggctccttaaatattctgccgcagttgggggaggagcgatggacccctaggtctccggaggctacacgtgttccccgatcccgtttccagggggagcccttccttcctattgcgctggtcgtgctcctggcccgcgtgcccaggaagggc

SEQ ID NO: 5541 - DNA, 186 bp, Homo sapiens
  chr1:65991321-65991507
  hyper
acctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtggga

SEQ ID NO: 5542 - DNA, 30 bp, Homo sapiens
  chr1:66258273-66258303
  hyper
ctggtaccgtgcccgcggaatattgcagga

SEQ ID NO: 5543 - DNA, 41 bp, Homo sapiens
  chr1:66258719-66258760
  hyper
cggctgcaggctcttcgtcgcgggccgggctgcacgcgagc

SEQ ID NO: 5544 - DNA, 13 bp, Homo sapiens
  chr1:66258761-66258774
  hyper
ccctccgggcaga

SEQ ID NO: 5545 - DNA, 139 bp, Homo sapiens
  chr1:66259292-66259431
  hyper
attgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 5546 - DNA, 462 bp, Homo sapiens; identical to SEQ ID NO: 63
  chr1:66998790-66999252
  hyper

SEQ ID NO: 5547 - DNA, 43 bp, Homo sapiens
  chr1:66999572-66999615
  hyper
gtaagcttaaggagacgacgaggaggggcgggggaagtgcgtc

SEQ ID NO: 5548 - DNA, 378 bp, Homo sapiens; identical to SEQ ID NO: 64
  chr1:67217965-67218343
  hyper

SEQ ID NO: 5549 - DNA, 621 bp, Homo sapiens; identical to SEQ ID NO: 1746
  chr1:67773159-67773780
  hyper

SEQ ID NO: 5550 - DNA, 39 bp, Homo sapiens
  chr1:70033537-70033576
  hyper
aaaaaagagagggggcggggagagcggtgagacacagcc

SEQ ID NO: 5551 - DNA, 502 bp, Homo sapiens; identical to SEQ ID NO: 1747
  chr1:70033989-70034491
  hyper

SEQ ID NO: 5552 - DNA, 13 bp, Homo sapiens
  chr1:70034492-70034505
  hyper
gcgaagatgtggt

SEQ ID NO: 5553 - DNA, 43 bp, Homo sapiens
  chr1:70035121-70035164
  hyper
attaaggatgcaggacgtgtttcggattcgacgtggaaagagg

SEQ ID NO: 5554 - DNA, 48 bp, Homo sapiens
  chr1:71513699-71513747
  hyper
tctcctccagttctccgctaaagtgtcggtggacggcaagcagctaat

SEQ ID NO: 5555 - DNA, 76 bp, Homo sapiens
  chr1:72747951-72748027
  hyper
gacagaaagatagaccgaaacaagtacgaaaagcacgccgttcttcctacctaagcaccgccgtgtccccttttct

SEQ ID NO: 5556 - DNA, 158 bp, Homo sapiens
  chr1:72750097-72750255
  hyper
aagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtgg

SEQ ID NO: 5557 - DNA, 30 bp, Homo sapiens
  chr1:72750522-72750552
  hyper
aatgttagtcatttgcggatgaatgaaaac

SEQ ID NO: 5558 - DNA, 30 bp, Homo sapiens
  chr1:75595334-75595364
  hyper
cctatccccagaaaccgagaaaaccatctg

SEQ ID NO: 5559 - DNA, 170 bp, Homo sapiens
  chr1:75595821-75595991
  hyper
gccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacac

SEQ ID NO: 5560 - DNA, 158 bp, Homo sapiens
  chr1:75596135-75596293
  hyper
cgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcac

SEQ ID NO: 5561 - DNA, 151 bp, Homo sapiens; identical to SEQ ID NO: 65
  chr1:75596708-75596859
  hyper

SEQ ID NO: 5562 - DNA, 418 bp, Homo sapiens; identical to SEQ ID NO: 66
  chr1:75596929-75597347
  hyper

SEQ ID NO: 5563 - DNA, 256 bp, Homo sapiens
  chr1:75597923-75598179
  hyper
cccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttc

SEQ ID NO: 5564 - DNA, 482 bp, Homo sapiens
  chr1:75600203-75600685
  hyper
cttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtcc

SEQ ID NO: 5565 - DNA, 433 bp, Homo sapiens
  chr1:75600686-75601119
  hyper
ggagagtgggtcgggaggactgggcggctgtcgggtggaaccggagacctggctcgtttcgttcggctgcccgcggacacttgcctgccctgaggcacacctccctctgcggggctccagaaaggcctccgggatccctgggcttgccgggagagccattttacctaaaatgccaaaagaaaaccgcagggcacaaaacgagtcacgcggtttgtctgagtagactggggaagctgacaagctctcacctcactcgggaggcaggacctgtgggtatttggtgttttaagtttgaaatcatctgcagcctgtctgagggcctcagcaggacgcgcgcggggcgcccctgactatttctttgctccgaagccggttggggacaccaggcgaaagcggagctgttctgtttaaacgccctttgtgtgtgaggacg

SEQ ID NO: 5566 - DNA, 89 bp, Homo sapiens
  chr1:75601187-75601276
  hyper
cggtccgggaggcccccaggttggtatcttgcctggtgcttccagagggagggagaaggggaggcgaacagtcagaaatgcagaagtgc

SEQ ID NO: 5567 - DNA, 151 bp, Homo sapiens
  chr1:75601277-75601428
  hyper
agccgctcgagttcggggtacccacccgcccccgagctagagtttttggaaacgaaagcggtctaagcccagggacgctgcgttttcgtttaagaacaaaactccagcaaatacttggaaacacttgagtaacgcgcgttgtttctttaaa

SEQ ID NO: 5568 - DNA, 369 bp, Homo sapiens; identical to SEQ ID NO: 1751
  chr1:75601983-75602352
  hyper

SEQ ID NO: 5569 - DNA, 416 bp, Homo sapiens
  chr1:75602743-75603159
  hyper
ggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 5570 - DNA, 449 bp, Homo sapiens
  chr1:76080278-76080727
  hyper
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcctcaggtccagttcccccgcgcacagccttcctcaccgcgcatggtgtcgagcccacttccacctctctgcagtgctgcagacaacctctagggctctgcgagtcccccagcgagagctagggagccgacaagctgcgacctctgcgagtccgcgctgcgggagcgggtggcttgcacctgctccccgcgcgccggctctgcgacccctaggcaagacgcagcccaggaggctccctcccgagtc

SEQ ID NO: 5571 - DNA, 230 bp, Homo sapiens
  chr1:76080728-76080958
  hyper
cgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggag

SEQ ID NO: 5572 - DNA, 223 bp, Homo sapiens
  chr1:76082155-76082378
  hyper
ctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 5573 - DNA, 30 bp, Homo sapiens
  chr1:76540210-76540240
  hyper
agcgcactctgcgcacgtcgagccgcgaaa

SEQ ID NO: 5574 - DNA, 76 bp, Homo sapiens
  chr1:76540498-76540574
  hyper
cccctgacccaggcgcgcccgctgctcggtggcaggagggccggcggagcgccatggcctgcatcctgaaggtaac

SEQ ID NO: 5575 - DNA, 13 bp, Homo sapiens
  chr1:76540575-76540588
  hyper
acttggatctgtg

SEQ ID NO: 5576 - DNA, 30 bp, Homo sapiens
  chr1:77333003-77333033
  hyper
gtgggtacactggctcggttaactctctct

SEQ ID NO: 5577 - DNA, 50 bp, Homo sapiens
  chr1:77333384-77333434
  hyper
ttgtggcaactccaccgggcaaagagggggatccccgggctcagggtcca

SEQ ID NO: 5578 - DNA, 218 bp, Homo sapiens; identical to SEQ ID NO: 67
  chr1:77334168-77334386
  hyper

SEQ ID NO: 5579 - DNA, 119 bp, Homo sapiens; identical to SEQ ID NO: 68
  chr1:77334408-77334527
  hyper

SEQ ID NO: 5580 - DNA, 54 bp, Homo sapiens
  chr1:77334828-77334882
  hyper
gaaccggagggtgagcgcagccagcccgcggccactgctcgggatccagcgttc

SEQ ID NO: 5581 - DNA, 75 bp, Homo sapiens
  chr1:77747307-77747382
  hyper
agttcctcggagacccggaggtaaccgtgtatgtgcgtgcgagtgtgtctgtgtgcgtacaaggtccggagaagc

SEQ ID NO: 5582 - DNA, 343 bp, Homo sapiens
  chr1:77747383-77747726
  hyper
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcc

SEQ ID NO: 5583 - DNA, 318 bp, Homo sapiens
  chr1:77748403-77748721
  hyper
aggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctgg

SEQ ID NO: 5584 - DNA, 178 bp, Homo sapiens
  chr1:78354744-78354922
  hyper
tgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcag

SEQ ID NO: 5585 - DNA, 403 bp, Homo sapiens
  chr1:78511453-78511856
  hyper
attgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 5586 - DNA, 497 bp, Homo sapiens
  chr1:78511857-78512354
  hyper
cgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttccc

SEQ ID NO: 5587 - DNA, 267 bp, Homo sapiens; identical to SEQ ID NO: 1754
  chr1:78957231-78957498
  hyper

SEQ ID NO: 5588 - DNA, 30 bp, Homo sapiens
  chr1:82267630-82267660
  hyper
gcgtgtgggaaactgcgggaaaatgttgac

SEQ ID NO: 5589 - DNA, 49 bp, Homo sapiens
  chr1:82267942-82267991
  hyper
ctctgtgcccagcttcggagacctgtttgctttgcgcctccagtccggg

SEQ ID NO: 5590 - DNA, 30 bp, Homo sapiens
  chr1:82268226-82268256
  hyper
ttaggatgaggctcccgtagccatgcattt

SEQ ID NO: 5591 - DNA, 132 bp, Homo sapiens
  chr1:85358461-85358593
  hyper
gctttttgctcctagcggggaaaaaggtgggaaaagagcaagttgtgccatacacccgccgggagagtcttgtcccggggtttggagtgggtctggagcccaggcttgcacgccaggcaaccccgaaaagcc

SEQ ID NO: 5592 - DNA, 71 bp, Homo sapiens
  chr1:85358751-85358822
  hyper
cgcatgccctcggggtcgagcgcgacggggcgaccgggcgccgggctccagccgggcgcggagaagcagcg

SEQ ID NO: 5593 - DNA, 59 bp, Homo sapiens
  chr1:85359218-85359277
  hyper
tgtttgaagtggctgcgggaagtgcagcccacacccaccacccccgtgggaggcaggct

SEQ ID NO: 5594 - DNA, 69 bp, Homo sapiens
  chr1:85463878-85463947
  hyper
aaagtgcgaccggcgcgcaaggaataggaaaagcgagttgccctgcgcccgcgtcgggatgaaaggcag

SEQ ID NO: 5595 - DNA, 335 bp, Homo sapiens
  chr1:86621580-86621915
  hyper
tagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaa

SEQ ID NO: 5596 - DNA, 26 bp, Homo sapiens
  chr1:86622526-86622552
  hyper
tccttggaaacagcccgcgcccgaac

SEQ ID NO: 5597 - DNA, 51 bp, Homo sapiens
  chr1:87617774-87617825
  hyper
cttgcagagtggccccgccgccgtcctgaactttctcgggaggggaaggcg

SEQ ID NO: 5598 - DNA, 590 bp, Homo sapiens; identical to SEQ ID NO: 1755
  chr1:91172087-91172677
  hyper

SEQ ID NO: 5599 - DNA, 147 bp, Homo sapiens
  chr1:91176423-91176570
  hyper
taggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcc

SEQ ID NO: 5600 - DNA, 45 bp, Homo sapiens
  chr1:91176908-91176953
  hyper
tatcaaataatggttcggaagaggccagcacgaaaaatggagctg

SEQ ID NO: 5601 - DNA, 417 bp, Homo sapiens; identical to SEQ ID NO: 69
  chr1:91177840-91178257
  hyper

SEQ ID NO: 5602 - DNA, 241 bp, Homo sapiens; identical to SEQ ID NO: 70
  chr1:91181807-91182048
  hyper

SEQ ID NO: 5603 - DNA, 162 bp, Homo sapiens; identical to SEQ ID NO: 1758
  chr1:91182320-91182482
  hyper

SEQ ID NO: 5604 - DNA, 84 bp, Homo sapiens
  chr1:91183284-91183368
  hyper
tcccgaggtggcagccgcgcgccactcggcagccccgtagccgagtttctgaactttcttggaaagttgcggggcagacacggc

SEQ ID NO: 5605 - DNA, 30 bp, Homo sapiens
  chr1:91183775-91183805
  hyper
cgagtccagtggtcccggtgtccacaatca

SEQ ID NO: 5606 - DNA, 139 bp, Homo sapiens; identical to SEQ ID NO: 1759
  chr1:91184274-91184413
  hyper

SEQ ID NO: 5607 - DNA, 73 bp, Homo sapiens; identical to SEQ ID NO: 1760
  chr1:91184414-91184487
  hyper

SEQ ID NO: 5608 - DNA, 30 bp, Homo sapiens
  chr1:91184823-91184853
  hyper
ctccaaaggctgggccgaaatctggagttt

SEQ ID NO: 5609 - DNA, 119 bp, Homo sapiens; identical to SEQ ID NO: 1761
  chr1:91185190-91185309
  hyper

SEQ ID NO: 5610 - DNA, 230 bp, Homo sapiens; identical to SEQ ID NO: 1762
  chr1:91185347-91185577
  hyper

SEQ ID NO: 5611 - DNA, 481 bp, Homo sapiens; identical to SEQ ID NO: 71
  chr1:91188983-91189464
  hyper

SEQ ID NO: 5612 - DNA, 34 bp, Homo sapiens
  chr1:91189724-91189758
  hyper
ctcccacccagcccacgcgcgcttccccaccccc

SEQ ID NO: 5613 - DNA, 269 bp, Homo sapiens; identical to SEQ ID NO: 72
  chr1:91190137-91190406
  hyper

SEQ ID NO: 5614 - DNA, 80 bp, Homo sapiens; identical to SEQ ID NO: 1765
  chr1:91190869-91190949
  hyper

SEQ ID NO: 5615 - DNA, 17 bp, Homo sapiens
  chr1:91190984-91191001
  hyper
cggagagtgcccctccc

SEQ ID NO: 5616 - DNA, 233 bp, Homo sapiens; identical to SEQ ID NO: 1767
  chr1:91191002-91191235
  hyper

SEQ ID NO: 5617 - DNA, 249 bp, Homo sapiens; identical to SEQ ID NO: 1768
  chr1:91191289-91191538
  hyper

SEQ ID NO: 5618 - DNA, 233 bp, Homo sapiens; identical to SEQ ID NO: 73
  chr1:91192344-91192577
  hyper

SEQ ID NO: 5619 - DNA, 54 bp, Homo sapiens; identical to SEQ ID NO: 74
  chr1:91192681-91192735
  hyper

SEQ ID NO: 5620 - DNA, 71 bp, Homo sapiens
  chr1:91194749-91194820
  hyper
gagctgcaggaaaaccgaatcgcgcttagggtcaggagcaagacaggagctttcagcgaagatctgaacat

SEQ ID NO: 5621 - DNA, 242 bp, Homo sapiens; identical to SEQ ID NO: 75
  chr1:91195148-91195390
  hyper

SEQ ID NO: 5622 - DNA, 316 bp, Homo sapiens
  chr1:91195879-91196195
  hyper
taaaatcattgttcacgtgtcaatttaaaagaccattaaagcagcttattttggttttaattggaacctcctcccttccaactacaggcttaaaagaaaaaaaaaaaaaactctcccccacacccaggcgcgcgcacgcacgcgggcacgcagcagcgatggggatgtaggtcaccccgcgggttagggccacgcgcccgcactcccgccgcagccgcaaccgcagccgcagccgcagccaacgcggccgcggagcgacgcagtccgcagcctcgaatttccagaaattccagcactggcagcagcacgtctagtt

SEQ ID NO: 5623 - DNA, 201 bp, Homo sapiens
  chr1:91196225-91196426
  hyper
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaa

SEQ ID NO: 5624 - DNA, 71 bp, Homo sapiens; identical to SEQ ID NO: 1772
  chr1:91316261-91316332
  hyper

SEQ ID NO: 5625 - DNA, 128 bp, Homo sapiens
  chr1:91316627-91316755
  hyper
ccgcgctccacagcgcgtcacccgctgccctagcgacccccgggcgaccccggcatcgcctggctgcgccgtcccggcgggccggccctctccacgccctctcctggggtttgcggtgggcacagctc

SEQ ID NO: 5626 - DNA, 39 bp, Homo sapiens
  chr1:92495704-92495743
  hyper
ggtctactgctactgcgggctctgcgcctccatccacct

SEQ ID NO: 5627 - DNA, 146 bp, Homo sapiens; identical to SEQ ID NO: 1773
  chr1:92948451-92948597
  hyper

SEQ ID NO: 5628 - DNA, 439 bp, Homo sapiens
  chr1:92948817-92949256
  hyper
cagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 5629 - DNA, 41 bp, Homo sapiens
  chr1:92949786-92949827
  hyper
gaggggaacaacagacgaccaacccccgccccaggagaaac

SEQ ID NO: 5630 - DNA, 75 bp, Homo sapiens
  chr1:92950099-92950174
  hyper
acaaaaaagacaggacgccagagcgcgcaggctgcattagcagagagcgggggtcgggcccgggcccgggaggga

SEQ ID NO: 5631 - DNA, 182 bp, Homo sapiens
  chr1:92950668-92950850
  hyper
acctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaa

SEQ ID NO: 5632 - DNA, 215 bp, Homo sapiens
  chr1:92951530-92951745
  hyper
caccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccct

SEQ ID NO: 5633 - DNA, 135 bp, Homo sapiens; identical to SEQ ID NO: 1774
  chr1:92952304-92952439
  hyper

SEQ ID NO: 5634 - DNA, 270 bp, Homo sapiens
  chr1:98510761-98511031
  hyper
acctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttcc

SEQ ID NO: 5635 - DNA, 307 bp, Homo sapiens; identical to SEQ ID NO: 1775
  chr1:98511359-98511666
  hyper

SEQ ID NO: 5636 - DNA, 16 bp, Homo sapiens
  chr1:98515071-98515087
  hyper
gggaagggacctcggc

SEQ ID NO: 5637 - DNA, 103 bp, Homo sapiens
  chr1:98515088-98515191
  hyper
cctcgcgctggctgtgccccagtgccttcgcgtggtggcggcttgctcatgcttccgaggagtcccaggcgatagccttcagctgatgcgagcttccagaaag

SEQ ID NO: 5638 - DNA, 244 bp, Homo sapiens
  chr1:98519221-98519465
  hyper
tctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgc

SEQ ID NO: 5639 - DNA, 30 bp, Homo sapiens
  chr1:99469618-99469648
  hyper
agaggaggcagtgagcgagtcaaggccaca

SEQ ID NO: 5640 - DNA, 44 bp, Homo sapiens
  chr1:99469930-99469974
  hyper
cccgaaggcgaggggcgagatcagggactcggcgacgagggcga

SEQ ID NO: 5641 - DNA, 255 bp, Homo sapiens
  chr1:99470275-99470530
  hyper
ggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 5642 - DNA, 36 bp, Homo sapiens
  chr1:99470582-99470618
  hyper
cgctgggtcaatcccccaggctagcccggaggaggc

SEQ ID NO: 5643 - DNA, 166 bp, Homo sapiens
  chr1:99470619-99470785
  hyper
ctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctga

SEQ ID NO: 5644 - DNA, 361 bp, Homo sapiens; identical to SEQ ID NO: 1776
  chr1:101004456-101004817
  hyper

SEQ ID NO: 5645 - DNA, 653 bp, Homo sapiens; identical to SEQ ID NO: 1777
  chr1:101005071-101005724
  hyper

SEQ ID NO: 5646 - DNA, 78 bp, Homo sapiens
  chr1:101702524-101702602
  hyper
ggagggaggggaccccgactcgagtaagtttgcgagagcactacgcagtcagtcgggggcagcagcaagatgcgaagc

SEQ ID NO: 5647 - DNA, 155 bp, Homo sapiens
  chr1:101702603-101702758
  hyper
agccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaa

SEQ ID NO: 5648 - DNA, 30 bp, Homo sapiens
  chr1:101703188-101703218
  hyper
tctgctgaccagtgccgtcttagaaagttt

SEQ ID NO: 5649 - DNA, 43 bp, Homo sapiens
  chr1:101703599-101703642
  hyper
gaaagaaaaggcagtcgcttcacggaggcgctaagctttcctg

SEQ ID NO: 5650 - DNA, 226 bp, Homo sapiens
  chr1:101775150-101775376
  hyper
ttgcaggtggagcagcggcggctgcatcagcgtctcaaattgcgaaaacattttgggctgaagtatttctttgtagcatttcgtggagcccctttcctttgatatacactagccttccgacttccctttgttcttttttcacacgtcaggttttatcgctgacaagctccaacgcgtcaaaggcgttagatctgagggctgcagcagccttcgcggttccgcattg

SEQ ID NO: 5651 - DNA, 60 bp, Homo sapiens
  chr1:103572677-103572737
  hyper
gagggagggagaaggcggaggggaggagtgaagtcgctctccctccgtgggtactgacag

SEQ ID NO: 5652 - DNA, 281 bp, Homo sapiens
  chr1:103573722-103574003
  hyper
ccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttca

SEQ ID NO: 5653 - DNA, 107 bp, Homo sapiens
  chr1:107682658-107682765
  hyper
cttctgtggaggagccgggggggatggggagtagagggagggggccctgttgcctcagcgccccgaggtcgtggagcggcagcagctgcagccggagcagcaccagc

SEQ ID NO: 5654 - DNA, 604 bp, Homo sapiens; identical to SEQ ID NO: 1778
  chr1:107683171-107683775
  hyper

SEQ ID NO: 5655 - DNA, 13 bp, Homo sapiens
  chr1:107683776-107683789
  hyper
gggagtggcgggc

SEQ ID NO: 5656 - DNA, 182 bp, Homo sapiens
  chr1:107684241-107684423
  hyper
cgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctc

SEQ ID NO: 5657 - DNA, 450 bp, Homo sapiens; identical to SEQ ID NO: 76
  chr1:108506627-108507077
  hyper

SEQ ID NO: 5658 - DNA, 228 bp, Homo sapiens; identical to SEQ ID NO: 77
  chr1:108507148-108507376
  hyper

SEQ ID NO: 5659 - DNA, 113 bp, Homo sapiens; identical to SEQ ID NO: 78
  chr1:108507494-108507607
  hyper

SEQ ID NO: 5660 - DNA, 550 bp, Homo sapiens; identical to SEQ ID NO: 79
  chr1:108507657-108508207
  hyper

SEQ ID NO: 5661 - DNA, 340 bp, Homo sapiens; identical to SEQ ID NO: 80
  chr1:108508208-108508548
  hyper

SEQ ID NO: 5662 - DNA, 38 bp, Homo sapiens; identical to SEQ ID NO: 81
  chr1:108508549-108508587
  hyper

SEQ ID NO: 5663 - DNA, 591 bp, Homo sapiens
  chr1:109203618-109204209
  hyper
gcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 5664 - DNA, 66 bp, Homo sapiens
  chr1:109656914-109656980
  hyper
aggtgacccagggaacgggaccggagcttcatgcctgcaaagaggtactgccgcccccctacccga

SEQ ID NO: 5665 - DNA, 97 bp, Homo sapiens
  chr1:110009644-110009741
  hyper
accgccctgaccccccggccggctgtgtctccgcaggtggaccgcctactcgtggggctgcgctggcggcggctggaggagccgctgggcttcatca

SEQ ID NO: 5666 - DNA, 42 bp, Homo sapiens
  chr1:110283094-110283136
  hyper
agggcctggcgaccccgaggcgggacccgggcaggagtgctg

SEQ ID NO: 5667 - DNA, 312 bp, Homo sapiens; identical to SEQ ID NO: 82
  chr1:110610586-110610898
  hyper

SEQ ID NO: 5668 - DNA, 232 bp, Homo sapiens; identical to SEQ ID NO: 83
  chr1:110611045-110611277
  hyper

SEQ ID NO: 5669 - DNA, 80 bp, Homo sapiens; identical to SEQ ID NO: 84
  chr1:110611434-110611514
  hyper

SEQ ID NO: 5670 - DNA, 141 bp, Homo sapiens; identical to SEQ ID NO: 85
  chr1:110611653-110611794
  hyper

SEQ ID NO: 5671 - DNA, 1 bp, Homo sapiens
  chr1:110613458-110613459
  hyper
g

SEQ ID NO: 5672 - DNA, 128 bp, Homo sapiens; identical to SEQ ID NO: 1790
  chr1:110626790-110626918
  hyper

SEQ ID NO: 5673 - DNA, 480 bp, Homo sapiens; identical to SEQ ID NO: 1791
  chr1:110627133-110627613
  hyper

SEQ ID NO: 5674 - DNA, 193 bp, Homo sapiens
  chr1:110672889-110673082
  hyper
tgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgc

SEQ ID NO: 5675 - DNA, 204 bp, Homo sapiens
  chr1:110673083-110673287
  hyper
gtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatgg

SEQ ID NO: 5676 - DNA, 595 bp, Homo sapiens; identical to SEQ ID NO: 86
  chr1:110692902-110693497
  hyper

SEQ ID NO: 5677 - DNA, 433 bp, Homo sapiens; identical to SEQ ID NO: 87
  chr1:110693736-110694169
  hyper

SEQ ID NO: 5678 - DNA, 295 bp, Homo sapiens; identical to SEQ ID NO: 1794
  chr1:111097952-111098247
  hyper

SEQ ID NO: 5679 - DNA, 51 bp, Homo sapiens
  chr1:111149588-111149639
  hyper
ccaccagctcctctccgtgccctccgccccgcgccacgcaaaccccagagg

SEQ ID NO: 5680 - DNA, 239 bp, Homo sapiens; identical to SEQ ID NO: 88
  chr1:111216734-111216973
  hyper

SEQ ID NO: 5681 - DNA, 381 bp, Homo sapiens; identical to SEQ ID NO: 89
  chr1:111217194-111217575
  hyper

SEQ ID NO: 5682 - DNA, 136 bp, Homo sapiens; identical to SEQ ID NO: 90
  chr1:111217576-111217712
  hyper

SEQ ID NO: 5683 - DNA, 179 bp, Homo sapiens; identical to SEQ ID NO: 91
  chr1:111217713-111217892
  hyper

SEQ ID NO: 5684 - DNA, 93 bp, Homo sapiens; identical to SEQ ID NO: 92
  chr1:111217923-111218016
  hyper

SEQ ID NO: 5685 - DNA, 162 bp, Homo sapiens
  chr1:111506146-111506308
  hyper
ctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgac

SEQ ID NO: 5686 - DNA, 18 bp, Homo sapiens
  chr1:112283344-112283362
  hyper
agcactttgagaggccga

SEQ ID NO: 5687 - DNA, 36 bp, Homo sapiens
  chr1:112531573-112531609
  hyper
ttcgatccctctccccggggccgcgacggcccttgg

SEQ ID NO: 5688 - DNA, 366 bp, Homo sapiens; identical to SEQ ID NO: 1800
  chr1:114695329-114695695
  hyper

SEQ ID NO: 5689 - DNA, 41 bp, Homo sapiens; identical to SEQ ID NO: 1801
  chr1:114695696-114695737
  hyper

SEQ ID NO: 5690 - DNA, 310 bp, Homo sapiens; identical to SEQ ID NO: 1802
  chr1:114695799-114696109
  hyper

SEQ ID NO: 5691 - DNA, 44 bp, Homo sapiens
  chr1:114696420-114696464
  hyper
agcagctcgaacccgcgccccggccgcactggggcggggcacga

SEQ ID NO: 5692 - DNA, 172 bp, Homo sapiens
  chr1:114696540-114696712
  hyper
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccg

SEQ ID NO: 5693 - DNA, 79 bp, Homo sapiens
  chr1:115880128-115880207
  hyper
agggctgaaccttggcgacctctacctgaggttgtccaacgcggctccgtggagggccccggtacgccggacggacccc

SEQ ID NO: 5694 - DNA, 194 bp, Homo sapiens
  chr1:115880208-115880402
  hyper
gcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggt

SEQ ID NO: 5695 - DNA, 117 bp, Homo sapiens
  chr1:115880678-115880795
  hyper
ctgctcttcggcctgcgggagcctcgggggtaaccagagagctcgccagaccggtatccttgcaaactctcccgcgaagcccagccacccctgcccgcgcccgcgctgcgcccctct

SEQ ID NO: 5696 - DNA, 138 bp, Homo sapiens; identical to SEQ ID NO: 1803
  chr1:116371049-116371187
  hyper

SEQ ID NO: 5697 - DNA, 13 bp, Homo sapiens
  chr1:116371188-116371201
  hyper
tcagtcaattcag

SEQ ID NO: 5698 - DNA, 93 bp, Homo sapiens
  chr1:116371436-116371529
  hyper
agaggaggtgacagacgggcctgtaatttggttccattcgctcgactggagcaacacctgcccccctcccctgggacgcgagggtctcatccc

SEQ ID NO: 5699 - DNA, 70 bp, Homo sapiens
  chr1:116380312-116380382
  hyper
tctcgggtgtctccacgaggttctcctggcctggaaaatcccccctgcgagcccccgggctcgccagaca

SEQ ID NO: 5700 - DNA, 60 bp, Homo sapiens
  chr1:116380815-116380875
  hyper
ggtgcgggtagagcgcggctcggctgccgcccttgccgtcgccctcggcctcctccaccg

SEQ ID NO: 5701 - DNA, 75 bp, Homo sapiens
  chr1:116381534-116381609
  hyper
gggctgcgccgggggcgcctggctctggggtgcggccggtcaggaatccccatcctggagcgcaggcggagagcc

SEQ ID NO: 5702 - DNA, 35 bp, Homo sapiens
  chr1:116381836-116381871
  hyper
gaaaatgccggcagccgggccgctgagggaggaga

SEQ ID NO: 5703 - DNA, 98 bp, Homo sapiens
  chr1:116382400-116382498
  hyper
atcggttcccagcaccgcacttgcagaggagcgaattgggccaaaacagctttaatttccctgcgaggaaatcaggtcctctacggcaaaataaaaac

SEQ ID NO: 5704 - DNA, 180 bp, Homo sapiens
  chr1:116711112-116711292
  hyper
aagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 5705 - DNA, 15 bp, Homo sapiens
  chr1:119521978-119521993
  hyper
cgtcacgatcccaca

SEQ ID NO: 5706 - DNA, 15 bp, Homo sapiens
  chr1:119522839-119522854
  hyper
ttcccggaccctatc

SEQ ID NO: 5707 - DNA, 15 bp, Homo sapiens
  chr1:119522925-119522940
  hyper
cggttcatccagttg

SEQ ID NO: 5708 - DNA, 30 bp, Homo sapiens
  chr1:119528125-119528155
  hyper
atcctatcagcaaatcgttaagaaaggctt

SEQ ID NO: 5709 - DNA, 465 bp, Homo sapiens
  chr1:119528653-119529118
  hyper
aagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaat

SEQ ID NO: 5710 - DNA, 32 bp, Homo sapiens
  chr1:119529378-119529410
  hyper
cgttgtatgtgcgcgcgcgcacactcaagatt

SEQ ID NO: 5711 - DNA, 144 bp, Homo sapiens; identical to SEQ ID NO: 1805
  chr1:119530005-119530149
  hyper

SEQ ID NO: 5712 - DNA, 307 bp, Homo sapiens; identical to SEQ ID NO: 1806
  chr1:119530201-119530508
  hyper

SEQ ID NO: 5713 - DNA, 47 bp, Homo sapiens; identical to SEQ ID NO: 1807
  chr1:119530553-119530600
  hyper

SEQ ID NO: 5714 - DNA, 124 bp, Homo sapiens; identical to SEQ ID NO: 1808
  chr1:119530601-119530725
  hyper

SEQ ID NO: 5715 - DNA, 93 bp, Homo sapiens; identical to SEQ ID NO: 1809
  chr1:119531021-119531114
  hyper

SEQ ID NO: 5716 - DNA, 45 bp, Homo sapiens
  chr1:119535667-119535712
  hyper
gccacccggtttcctcgccttcggccgccgcggtgtggccggcag

SEQ ID NO: 5717 - DNA, 487 bp, Homo sapiens; identical to SEQ ID NO: 1810
  chr1:119543532-119544019
  hyper

SEQ ID NO: 5718 - DNA, 606 bp, Homo sapiens; identical to SEQ ID NO: 1811
  chr1:119549129-119549735
  hyper

SEQ ID NO: 5719 - DNA, 15 bp, Homo sapiens
  chr1:119549914-119549929
  hyper
cgtctaccccaaccc

SEQ ID NO: 5720 - DNA, 30 bp, Homo sapiens
  chr1:119550276-119550306
  hyper
tgtcttgttctttgacggggtggccctgtg

SEQ ID NO: 5721 - DNA, 285 bp, Homo sapiens; identical to SEQ ID NO: 93
  chr1:119551013-119551298
  hyper

SEQ ID NO: 5722 - DNA, 15 bp, Homo sapiens
  chr1:147775398-147775413
  hyper
ggatgctgggtctga

SEQ ID NO: 5723 - DNA, 102 bp, Homo sapiens
  chr1:147775495-147775597
  hyper
cggcaagatgtgcctctcaggttttccgaggctttggagcctgcacaattgttctacaaaaggcagtagctccgccgaacgttggatcgtcccttggtctgg

SEQ ID NO: 5724 - DNA, 76 bp, Homo sapiens
  chr1:150185869-150185945
  hyper
ccagaggaagcaaagcggaagtaggatccaaaacgctttcagcaggccgcctgcgcccccgcgcatgcgcaggtct

SEQ ID NO: 5725 - DNA, 30 bp, Homo sapiens
  chr1:151689335-151689365
  hyper
gtcagtctcaggggtcgaatacaaattctc

SEQ ID NO: 5726 - DNA, 337 bp, Homo sapiens; identical to SEQ ID NO: 1814
  chr1:151694069-151694406
  hyper

SEQ ID NO: 5727 - DNA, 30 bp, Homo sapiens
  chr1:152083749-152083779
  hyper
cttagttgctgctggcgcctctcctcctgc

SEQ ID NO: 5728 - DNA, 92 bp, Homo sapiens
  chr1:152084671-152084763
  hyper
gcctcagctgctgctcgcgcctctcctcctgctgctcgcgcctctcctgctgctcgcgcctctcctcctgctgctcgcgcctctcctcctcc

SEQ ID NO: 5729 - DNA, 446 bp, Homo sapiens
  chr1:152085058-152085504
  hyper
ttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtca

SEQ ID NO: 5730 - DNA, 129 bp, Homo sapiens
  chr1:152487828-152487957
  hyper
ttcttccaggtttgtcgtgaggagctccgcgatgtcctctcaacagagcgccgtttccgccaaaggcttttccaaggggtcgtcccagggccccgctccgtgtcccgccccggcgcccaccccggcgcc

SEQ ID NO: 5731 - DNA, 38 bp, Homo sapiens
  chr1:153438417-153438455
  hyper
gccagagttgcgaggcggttccacgtggctgggccgtc

SEQ ID NO: 5732 - DNA, 297 bp, Homo sapiens; identical to SEQ ID NO: 1815
  chr1:153651898-153652195
  hyper

SEQ ID NO: 5733 - DNA, 15 bp, Homo sapiens
  chr1:154474763-154474778
  hyper
tgctctttcctcctg

SEQ ID NO: 5734 - DNA, 81 bp, Homo sapiens; identical to SEQ ID NO: 95
  chr1:154474987-154475068
  hyper

SEQ ID NO: 5735 - DNA, 173 bp, Homo sapiens; identical to SEQ ID NO: 96
  chr1:154475371-154475544
  hyper

SEQ ID NO: 5736 - DNA, 233 bp, Homo sapiens
  chr1:155043442-155043675
  hyper
tttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctgg

SEQ ID NO: 5737 - DNA, 372 bp, Homo sapiens
  chr1:156215329-156215701
  hyper
agtagcaggagaggccggtgcacaggaaggagttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgaggaagtagcagatgtggcgcatgcggggcgacatggagctgaaggtgtgcgcgcagcacgacgcgaaggggtagaggcaggcgggcagcaggaaga

SEQ ID NO: 5738 - DNA, 662 bp, Homo sapiens; identical to SEQ ID NO: 97
  chr1:156357865-156358527
  hyper

SEQ ID NO: 5739 - DNA, 714 bp, Homo sapiens; identical to SEQ ID NO: 98
  chr1:156390135-156390849
  hyper

SEQ ID NO: 5740 - DNA, 59 bp, Homo sapiens
  chr1:156391157-156391216
  hyper
ggttgtgaaaatggccgggggttcgaggcgagcggtgctctaggggtgggaaaggggtg

SEQ ID NO: 5741 - DNA, 91 bp, Homo sapiens
  chr1:156391242-156391333
  hyper
cgaagagggtgggggctcggccggcccctcgtggcggacgcgcgggcacgccggattccgaggcgctcgcccacctcgtgctccacgctgg

SEQ ID NO: 5742 - DNA, 48 bp, Homo sapiens; identical to SEQ ID NO: 1821
  chr1:156405367-156405415
  hyper

SEQ ID NO: 5743 - DNA, 437 bp, Homo sapiens; identical to SEQ ID NO: 1822
  chr1:156405634-156406071
  hyper

SEQ ID NO: 5744 - DNA, 327 bp, Homo sapiens; identical to SEQ ID NO: 1823
  chr1:156406104-156406431
  hyper

SEQ ID NO: 5745 - DNA, 30 bp, Homo sapiens
  chr1:156468873-156468903
  hyper
tggacagctcccaaacgccaaaacacccaa

SEQ ID NO: 5746 - DNA, 170 bp, Homo sapiens
  chr1:156594433-156594603
  hyper
ctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtctt

SEQ ID NO: 5747 - DNA, 130 bp, Homo sapiens
  chr1:156594923-156595053
  hyper
gctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 5748 - DNA, 104 bp, Homo sapiens
  chr1:156595080-156595184
  hyper
cgctgcggggggctcccggatcccggagtgcgcagtttcggcttccccaggccccaacaggcagcctatgggacctactgctacgccgagaattaggcgcccac

SEQ ID NO: 5749 - DNA, 169 bp, Homo sapiens
  chr1:156611775-156611944
  hyper
gaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctca

SEQ ID NO: 5750 - DNA, 118 bp, Homo sapiens
  chr1:156611993-156612111
  hyper
cgtgcacccggaggagacccccggaggaggcgacaaacttcgcagtgccgcgacccaaccccagccctgggtaggtgagtgcctccgcagccccgccgcccgccgtggggtcggggac

SEQ ID NO: 5751 - DNA, 30 bp, Homo sapiens
  chr1:156626475-156626505
  hyper
gatggagacccaggccggaactccatccct

SEQ ID NO: 5752 - DNA, 169 bp, Homo sapiens
  chr1:156626850-156627019
  hyper
cagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcatt

SEQ ID NO: 5753 - DNA, 39 bp, Homo sapiens
  chr1:156646736-156646775
  hyper
tccgtcgtccgctcccgggccagccgcagctgctggcat

SEQ ID NO: 5754 - DNA, 20 bp, Homo sapiens
  chr1:156814933-156814953
  hyper
tgcaggcatggatgtcgatc

SEQ ID NO: 5755 - DNA, 210 bp, Homo sapiens; identical to SEQ ID NO: 1825
  chr1:156815030-156815240
  hyper

SEQ ID NO: 5756 - DNA, 107 bp, Homo sapiens
  chr1:156815635-156815742
  hyper
gacaggcggtctacccgcctctgatcccccccacctgccggggccctgcgcctccatctccccttccccacccgccccgcggccggcctgcgcgtcgtccctgcgca

SEQ ID NO: 5757 - DNA, 422 bp, Homo sapiens
  chr1:156818607-156819029
  hyper
gggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttgg

SEQ ID NO: 5758 - DNA, 425 bp, Homo sapiens; identical to SEQ ID NO: 99
  chr1:156863061-156863486
  hyper

SEQ ID NO: 5759 - DNA, 69 bp, Homo sapiens; identical to SEQ ID NO: 100
  chr1:156863640-156863709
  hyper

SEQ ID NO: 5760 - DNA, 17 bp, Homo sapiens
  chr1:156893962-156893979
  hyper
ggccaaatggagggacg

SEQ ID NO: 5761 - DNA, 40 bp, Homo sapiens
  chr1:156894252-156894292
  hyper
cctggagagcaaatacgtgttcttccggcccaccatccag

SEQ ID NO: 5762 - DNA, 54 bp, Homo sapiens
  chr1:157963737-157963791
  hyper
tgtttcctctggctgcgcgggagaaccgagcaatggggccgcgagggctggagg

SEQ ID NO: 5763 - DNA, 401 bp, Homo sapiens
  chr1:158083182-158083583
  hyper
ccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagccctcccctgccctcctctgctcctccgtaactcctgagct

SEQ ID NO: 5764 - DNA, 44 bp, Homo sapiens; identical to SEQ ID NO: 1828
  chr1:158150605-158150649
  hyper

SEQ ID NO: 5765 - DNA, 147 bp, Homo sapiens; identical to SEQ ID NO: 1829
  chr1:158150650-158150797
  hyper

SEQ ID NO: 5766 - DNA, 104 bp, Homo sapiens; identical to SEQ ID NO: 1830
  chr1:158150798-158150902
  hyper

SEQ ID NO: 5767 - DNA, 36 bp, Homo sapiens; identical to SEQ ID NO: 1831
  chr1:159158333-159158369
  hyper

SEQ ID NO: 5768 - DNA, 40 bp, Homo sapiens; identical to SEQ ID NO: 1832
  chr1:159158471-159158511
  hyper

SEQ ID NO: 5769 - DNA, 30 bp, Homo sapiens
  chr1:161068529-161068559
  hyper
gtacgattgggagcccggggcagccccccg

SEQ ID NO: 5770 - DNA, 438 bp, Homo sapiens; identical to SEQ ID NO: 1833
  chr1:161275639-161276077
  hyper

SEQ ID NO: 5771 - DNA, 49 bp, Homo sapiens
  chr1:161409851-161409900
  hyper
acaccctccaaacaccgcaagcctccttccccggcgcacaggcacgcag

SEQ ID NO: 5772 - DNA, 152 bp, Homo sapiens
  chr1:161494827-161494979
  hyper
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgag

SEQ ID NO: 5773 - DNA, 30 bp, Homo sapiens
  chr1:161591710-161591740
  hyper
tgccttagtgctgtacgggtaattttgagg

SEQ ID NO: 5774 - DNA, 169 bp, Homo sapiens
  chr1:162792306-162792475
  hyper
gcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgct

SEQ ID NO: 5775 - DNA, 65 bp, Homo sapiens
  chr1:164290599-164290664
  hyper
gccagctccgggggccgcgcttccagccacccgcagccggcggggcccgccgggcagcacgggaa

SEQ ID NO: 5776 - DNA, 30 bp, Homo sapiens
  chr1:165204427-165204457
  hyper
agtacccagaagacccgggagctaggacca

SEQ ID NO: 5777 - DNA, 58 bp, Homo sapiens
  chr1:165204838-165204896
  hyper
gacgtcacctgggaacgcgcggcggcgcggggcggcgcggacccgggacgacctcgcc

SEQ ID NO: 5778 - DNA, 30 bp, Homo sapiens
  chr1:165321661-165321691
  hyper
aaaagcccctgcatccgagggttctgcaga

SEQ ID NO: 5779 - DNA, 37 bp, Homo sapiens
  chr1:165324212-165324249
  hyper
gcgcggtctaatccccgcgctgcgttgcctactggcc

SEQ ID NO: 5780 - DNA, 56 bp, Homo sapiens; identical to SEQ ID NO: 1834
  chr1:165324488-165324544
  hyper

SEQ ID NO: 5781 - DNA, 66 bp, Homo sapiens
  chr1:165324832-165324898
  hyper
aaacgatgcgtctgacgtccgtgcccgctgggactcggcgccagcagccaccgcactcctgggaaa

SEQ ID NO: 5782 - DNA, 145 bp, Homo sapiens
  chr1:165325108-165325253
  hyper
ccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgc

SEQ ID NO: 5783 - DNA, 489 bp, Homo sapiens; identical to SEQ ID NO: 1835
  chr1:165325716-165326205
  hyper

SEQ ID NO: 5784 - DNA, 173 bp, Homo sapiens; identical to SEQ ID NO: 1836
  chr1:165326296-165326469
  hyper

SEQ ID NO: 5785 - DNA, 39 bp, Homo sapiens
  chr1:165414376-165414415
  hyper
cacgcataatgctgccgccgccgccgccgccgccgtcac

SEQ ID NO: 5786 - DNA, 39 bp, Homo sapiens
  chr1:166134243-166134282
  hyper
taaatataaaagtcccggacgcgaccgcccgtagcctgc

SEQ ID NO: 5787 - DNA, 77 bp, Homo sapiens
  chr1:166134283-166134360
  hyper
gcccctggcggttgaggagccgcggcgatccttggtcttcaccgcagcagccaagcccggcgcgcaccaaccggcgc

SEQ ID NO: 5788 - DNA, 243 bp, Homo sapiens
  chr1:166134648-166134891
  hyper
ggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacgg

SEQ ID NO: 5789 - DNA, 645 bp, Homo sapiens
  chr1:166134933-166135578
  hyper
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcg

SEQ ID NO: 5790 - DNA, 55 bp, Homo sapiens
  chr1:166916866-166916921
  hyper
ggtgccacccactctcgcgcctgcccccagcccccgtttcctcccccgctcgggc

SEQ ID NO: 5791 - DNA, 14 bp, Homo sapiens
  chr1:166916936-166916950
  hyper
cgactacaatgcag

SEQ ID NO: 5792 - DNA, 636 bp, Homo sapiens; identical to SEQ ID NO: 1837
  chr1:167599216-167599852
  hyper

SEQ ID NO: 5793 - DNA, 278 bp, Homo sapiens; identical to SEQ ID NO: 101
  chr1:169396357-169396635
  hyper

SEQ ID NO: 5794 - DNA, 53 bp, Homo sapiens; identical to SEQ ID NO: 102
  chr1:169396636-169396689
  hyper

SEQ ID NO: 5795 - DNA, 193 bp, Homo sapiens; identical to SEQ ID NO: 103
  chr1:169396730-169396923
  hyper

SEQ ID NO: 5796 - DNA, 144 bp, Homo sapiens; identical to SEQ ID NO: 104
  chr1:170630458-170630602
  hyper

SEQ ID NO: 5797 - DNA, 207 bp, Homo sapiens; identical to SEQ ID NO: 105
  chr1:170630603-170630810
  hyper

SEQ ID NO: 5798 - DNA, 30 bp, Homo sapiens
  chr1:170631084-170631114
  hyper
ctcttgactataggacgaaaaaaaaaaaaa

SEQ ID NO: 5799 - DNA, 130 bp, Homo sapiens
  chr1:170631315-170631445
  hyper
gtcaggttagggctccgcagacggacgacagaggattatccgtagacttagatgggggttcctccgcccctctctgtcctcctgccaccacagccaggctggacgcagaaccgcacggaagcctccccaa

SEQ ID NO: 5800 - DNA, 91 bp, Homo sapiens
  chr1:170633906-170633997
  hyper
tcggttcatcccgcacgcggggcggcggggctgggctgggaaaaggtcttagcggggtgcaaactcagagagccagcgctgtttgggaaag

SEQ ID NO: 5801 - DNA, 30 bp, Homo sapiens
  chr1:170634253-170634283
  hyper
tggcttgggaaaactcgggccaagcaaagg

SEQ ID NO: 5802 - DNA, 76 bp, Homo sapiens
  chr1:170640549-170640625
  hyper
cccccaccccatcttcgcagttctcctctctgctgtagcgacgccaggcgctgctttccgccgggtaaattagcgg

SEQ ID NO: 5803 - DNA, 595 bp, Homo sapiens; identical to SEQ ID NO: 106
  chr1:171810200-171810795
  hyper

SEQ ID NO: 5804 - DNA, 126 bp, Homo sapiens
  chr1:171811091-171811217
  hyper
tggggggcagagtggcggtgtccgtggggcgggcggggtcctccagctctgggcatcctccgtcccctgccaccccccgcctggtggccctcctgcctgcctttcatcgtgcgatacaaagccatt

SEQ ID NO: 5805 - DNA, 267 bp, Homo sapiens
  chr1:173638672-173638939
  hyper
tgatccaggaggtcccgcgagggggcaacggacacttcagggcaccagagtttgctcttcggcctgaattccctagggaccttctgcgatcccttgcggctgccggcggggtaggagaccggtgcgcaaagctctggacagaagcagtgtgaggacgctgagattgaagcccactcccctccagccctgcccgagcagcctggagggaagatgtccgtctaccccatcgcactcctccccaagtgcccaccccggcccacagcgcca

SEQ ID NO: 5806 - DNA, 30 bp, Homo sapiens
  chr1:177133445-177133475
  hyper
agtgggtgtgtagagcgagctggagtgggg

SEQ ID NO: 5807 - DNA, 147 bp, Homo sapiens
  chr1:177133766-177133913
  hyper
gcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttaggg

SEQ ID NO: 5808 - DNA, 376 bp, Homo sapiens; identical to SEQ ID NO: 1844
  chr1:177140304-177140680
  hyper

SEQ ID NO: 5809 - DNA, 405 bp, Homo sapiens
  chr1:177150773-177151178
  hyper
tgccaccccctcactcggtgttcagccatttatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggg

SEQ ID NO: 5810 - DNA, 291 bp, Homo sapiens
  chr1:179544800-179545091
  hyper
cgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 5811 - DNA, 63 bp, Homo sapiens
  chr1:179545092-179545155
  hyper
tgcccgggggaccctaaagaccgtcgggtgggggctgagggcgaggggcgggacaccggggcc

SEQ ID NO: 5812 - DNA, 30 bp, Homo sapiens
  chr1:179712006-179712036
  hyper
ttccagggcacagtgcgggccggaaatagg

SEQ ID NO: 5813 - DNA, 102 bp, Homo sapiens
  chr1:179712632-179712734
  hyper
gccgggctcgggctccgcgcggggatgtgtctggccaccgcgtactttcgagggcgcctcaacacccgggtaagcgcgccccggctgcctccctctgcccac

SEQ ID NO: 5814 - DNA, 145 bp, Homo sapiens
  chr1:179712830-179712975
  hyper
cgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctt

SEQ ID NO: 5815 - DNA, 300 bp, Homo sapiens
  chr1:180198156-180198456
  hyper
gagcgcctgatggagcgtcagaggagacctcgtcccagcgttgggccttctgttgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcaggg

SEQ ID NO: 5816 - DNA, 158 bp, Homo sapiens
  chr1:180202237-180202395
  hyper
aaatccagcttatttcggcggcagctggactattcctttgcttatttggggatgggtgaggggcataccctttaggaaaacgtttccaaatgatgtaataatttctctctcatctctggtcttgctccagacttggcctcttcctcgccactctgtcc

SEQ ID NO: 5817 - DNA, 499 bp, Homo sapiens; identical to SEQ ID NO: 1845
  chr1:180202658-180203157
  hyper

SEQ ID NO: 5818 - DNA, 243 bp, Homo sapiens; identical to SEQ ID NO: 1846
  chr1:180203365-180203608
  hyper

SEQ ID NO: 5819 - DNA, 588 bp, Homo sapiens; identical to SEQ ID NO: 1847
  chr1:180203633-180204221
  hyper

SEQ ID NO: 5820 - DNA, 398 bp, Homo sapiens; identical to SEQ ID NO: 1848
  chr1:180204222-180204620
  hyper

SEQ ID NO: 5821 - DNA, 18 bp, Homo sapiens
  chr1:180204897-180204915
  hyper
cgccggggaaggcgaggt

SEQ ID NO: 5822 - DNA, 30 bp, Homo sapiens
  chr1:180205341-180205371
  hyper
tgggggtgggagagccgggaaaccagcaaa

SEQ ID NO: 5823 - DNA, 33 bp, Homo sapiens
  chr1:180206330-180206363
  hyper
cacaggggttttactcggcggggggggcgggga

SEQ ID NO: 5824 - DNA, 118 bp, Homo sapiens
  chr1:180881433-180881551
  hyper
ggcggcgggcaattccggcaccgcggcagacgggatgcgcggagcgcgttccctccgggtttccctcacgcctctggagagcgggaaccaacgaccttgacctcggaggaaacggctc

SEQ ID NO: 5825 - DNA, 30 bp, Homo sapiens
  chr1:180882303-180882333
  hyper
ctggaagtccctccccgaacccagcagctg

SEQ ID NO: 5826 - DNA, 201 bp, Homo sapiens
  chr1:181287452-181287653
  hyper
tgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggag

SEQ ID NO: 5827 - DNA, 64 bp, Homo sapiens; identical to SEQ ID NO: 1850
  chr1:181288138-181288202
  hyper

SEQ ID NO: 5828 - DNA, 978 bp, Homo sapiens; identical to SEQ ID NO: 1851
  chr1:181451381-181452359
  hyper

SEQ ID NO: 5829 - DNA, 276 bp, Homo sapiens
  chr1:181452691-181452967
  hyper
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaaccccc

SEQ ID NO: 5830 - DNA, 34 bp, Homo sapiens
  chr1:181454728-181454762
  hyper
ctagggtggaggtttcgggcgggggaggggtcgg

SEQ ID NO: 5831 - DNA, 297 bp, Homo sapiens
  chr1:181454977-181455274
  hyper
cctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtctta

SEQ ID NO: 5832 - DNA, 196 bp, Homo sapiens
  chr1:183386107-183386303
  hyper
tcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaag

SEQ ID NO: 5833 - DNA, 65 bp, Homo sapiens
  chr1:183386598-183386663
  hyper
cggctccggctcgcgcagggcctcccgcagcctccgcccggccccctccccgtcctaggcagcgg

SEQ ID NO: 5834 - DNA, 334 bp, Homo sapiens; identical to SEQ ID NO: 1852
  chr1:183387266-183387600
  hyper

SEQ ID NO: 5835 - DNA, 72 bp, Homo sapiens
  chr1:183774357-183774429
  hyper
gcccagcagacattgcgttggcctccgagcagggcgcatcatgcagcgttcgcgcaccggagagaaaactga

SEQ ID NO: 5836 - DNA, 113 bp, Homo sapiens
  chr1:184005701-184005814
  hyper
cctggagcaggagcccggcaccggaaagtcagagcagcgcactgcggcgccccagccactgcggagcccctggccaaccgcagttacgttccatctgtcgtatctacatggga

SEQ ID NO: 5837 - DNA, 39 bp, Homo sapiens
  chr1:184006034-184006073
  hyper
cctccgcagcctgaccgcccgatccgccagccaccggcg

SEQ ID NO: 5838 - DNA, 138 bp, Homo sapiens
  chr1:184006332-184006470
  hyper
ggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggt

SEQ ID NO: 5839 - DNA, 147 bp, Homo sapiens
  chr1:190444251-190444398
  hyper
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacg

SEQ ID NO: 5840 - DNA, 16 bp, Homo sapiens
  chr1:190445181-190445197
  hyper
cacagtctcaaccccc

SEQ ID NO: 5841 - DNA, 23 bp, Homo sapiens
  chr1:190445198-190445221
  hyper
ttccctctcggtgggagtcaagg

SEQ ID NO: 5842 - DNA, 71 bp, Homo sapiens
  chr1:190445481-190445552
  hyper
tttgagggcggggggcggatgttcagagaaaaccctcagtgggtgttaaaaattaccgatacatgcaggtt

SEQ ID NO: 5843 - DNA, 326 bp, Homo sapiens
  chr1:190447388-190447714
  hyper
cgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatctt

SEQ ID NO: 5844 - DNA, 84 bp, Homo sapiens
  chr1:196578066-196578150
  hyper
agcatagcacagtgacggcacgggggtgccttggggacaaccaatgggggcgagctaattagcggattgcggggctccagaccc

SEQ ID NO: 5845 - DNA, 62 bp, Homo sapiens; identical to SEQ ID NO: 107
  chr1:197879599-197879661
  hyper

SEQ ID NO: 5846 - DNA, 508 bp, Homo sapiens; identical to SEQ ID NO: 108
  chr1:197879716-197880224
  hyper

SEQ ID NO: 5847 - DNA, 111 bp, Homo sapiens
  chr1:197880543-197880654
  hyper
taacccctgcctgcccgggtccaagtgagggttttctcccggaaggttaatcaccacccccatcccctagccgggtcccgggaggaagagatgccccggctctctcgttga

SEQ ID NO: 5848 - DNA, 90 bp, Homo sapiens
  chr1:197881455-197881545
  hyper
ttcttgggagcctaccggaggaaggcccggctttgctccaagccgcgtccctacctgaggtctccacgggaggagcggtttggacgcgcc

SEQ ID NO: 5849 - DNA, 68 bp, Homo sapiens
  chr1:197882140-197882208
  hyper
tcagtcctaacccagcgcagccgtttctgcgcctgatctcagcggacgcagtgcgggacttctccctt

SEQ ID NO: 5850 - DNA, 60 bp, Homo sapiens
  chr1:197885234-197885294
  hyper
ctctctgggtaaagccgcgttggttcctgccgcagcgctgtgcttcggactcctaggggg

SEQ ID NO: 5851 - DNA, 160 bp, Homo sapiens; identical to SEQ ID NO: 109
  chr1:197886907-197887067
  hyper

SEQ ID NO: 5852 - DNA, 311 bp, Homo sapiens; identical to SEQ ID NO: 110
  chr1:197887146-197887457
  hyper

SEQ ID NO: 5853 - DNA, 416 bp, Homo sapiens; identical to SEQ ID NO: 111
  chr1:197887706-197888122
  hyper

SEQ ID NO: 5854 - DNA, 45 bp, Homo sapiens; identical to SEQ ID NO: 112
  chr1:197888180-197888225
  hyper

SEQ ID NO: 5855 - DNA, 33 bp, Homo sapiens
  chr1:197888734-197888767
  hyper
gttttattttgtgtgcgtcgaaaaccacaattt

SEQ ID NO: 5856 - DNA, 67 bp, Homo sapiens
  chr1:197889096-197889163
  hyper
tgcagggcatgcccccgctcagcccggagaagcccgccctgtgcgccggctgcgggggcaagatctc

SEQ ID NO: 5857 - DNA, 81 bp, Homo sapiens
  chr1:197889549-197889630
  hyper
tctcagcttggctggcggaacttggggaaatctggggaagagtaaatggacgtggtctccgtctaccgagacttgattggg

SEQ ID NO: 5858 - DNA, 55 bp, Homo sapiens
  chr1:197890716-197890771
  hyper
accgtgcagaaagggcggccccggaagcggaagagcccagcgctgggagtggaca

SEQ ID NO: 5859 - DNA, 181 bp, Homo sapiens
  chr1:199998199-199998380
  hyper
agcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgccc

SEQ ID NO: 5860 - DNA, 30 bp, Homo sapiens
  chr1:199998758-199998788
  hyper
ctcccctggcctcagcgagactaccccaac

SEQ ID NO: 5861 - DNA, 299 bp, Homo sapiens; identical to SEQ ID NO: 113
  chr1:200009750-200010049
  hyper

SEQ ID NO: 5862 - DNA, 361 bp, Homo sapiens; identical to SEQ ID NO: 1862
  chr1:200011323-200011684
  hyper

SEQ ID NO: 5863 - DNA, 383 bp, Homo sapiens; identical to SEQ ID NO: 1863
  chr1:200011685-200012068
  hyper

SEQ ID NO: 5864 - DNA, 42 bp, Homo sapiens
  chr1:201252751-201252793
  hyper
gcccgcccgctgcaccgcacctcgcctcgcctctctgctctc

SEQ ID NO: 5865 - DNA, 22 bp, Homo sapiens
  chr1:201437642-201437664
  hyper
tcttccagggggcagcggaagt

SEQ ID NO: 5866 - DNA, 105 bp, Homo sapiens
  chr1:201437682-201437787
  hyper
cggtcaccagcgtgaagtagatgtggcgcccggtgctctccacgcactccacggccttgatgcgggcgaagctgagctccttgggccggccgcccgtgcccttgg

SEQ ID NO: 5867 - DNA, 42 bp, Homo sapiens
  chr1:202678998-202679040
  hyper
gggggctgggctagacgcgagtgggttcgtcccagggaaagg

SEQ ID NO: 5868 - DNA, 68 bp, Homo sapiens
  chr1:202679353-202679421
  hyper
ccgtgcccccaccggcgggggtatggacttaccggagagcgacccgaaggaggcgggagagatccggg

SEQ ID NO: 5869 - DNA, 33 bp, Homo sapiens
  chr1:202679642-202679675
  hyper
ggggaggagaccaagcggcgtgggagggcgggg

SEQ ID NO: 5870 - DNA, 136 bp, Homo sapiens
  chr1:202996095-202996231
  hyper
gagagtcagaaaaagcgcctctcggctccggggccaaccccactcctttggggacgcgattctgatgggctgaggtcttcgctcttcgcgggggtcttaatctttcccgagttgctcatagcacccctgttcctgt

SEQ ID NO: 5871 - DNA, 227 bp, Homo sapiens; identical to SEQ ID NO: 1864
  chr1:204653792-204654019
  hyper

SEQ ID NO: 5872 - DNA, 104 bp, Homo sapiens
  chr1:204797791-204797895
  hyper
gtctctgccctaatgcggcggctggcggcgagaggcgctgcaggggacgcgggggaagtggcggcgccggcagcggacagctcggacagcgcccagggccggag

SEQ ID NO: 5873 - DNA, 91 bp, Homo sapiens
  chr1:204798150-204798241
  hyper
ctatctcgttggccgcgtcccctcccccttcccgcatcctcaaccctttccctttcctctctgtccccgcctcatccgtgagccctgcctg

SEQ ID NO: 5874 - DNA, 376 bp, Homo sapiens; identical to SEQ ID NO: 114
  chr1:205312536-205312912
  hyper

SEQ ID NO: 5875 - DNA, 416 bp, Homo sapiens
  chr1:205399689-205400105
  hyper
aaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgaga

SEQ ID NO: 5876 - DNA, 357 bp, Homo sapiens; identical to SEQ ID NO: 1866
  chr1:205424654-205425011
  hyper

SEQ ID NO: 5877 - DNA, 407 bp, Homo sapiens; identical to SEQ ID NO: 115
  chr1:207669381-207669788
  hyper

SEQ ID NO: 5878 - DNA, 232 bp, Homo sapiens; identical to SEQ ID NO: 116
  chr1:207669828-207670060
  hyper

SEQ ID NO: 5879 - DNA, 224 bp, Homo sapiens; identical to SEQ ID NO: 1869
  chr1:208084174-208084398
  hyper

SEQ ID NO: 5880 - DNA, 39 bp, Homo sapiens
  chr1:209381523-209381562
  hyper
ccattgccctcagcccgcagttcacggccagccccagtg

SEQ ID NO: 5881 - DNA, 65 bp, Homo sapiens
  chr1:210111357-210111422
  hyper
aggttggggtgggggcggggtggcgtcacgtgccagcggcggccccgggaaggttccatttcttc

SEQ ID NO: 5882 - DNA, 100 bp, Homo sapiens
  chr1:210111823-210111923
  hyper
gctcgccccggccttcgtggttttgccggcctcccggcggccgcacgcggggcaaagcgggctggcgggcaggtacagcgtccgggccgccgcctcctgc

SEQ ID NO: 5883 - DNA, 31 bp, Homo sapiens
  chr1:210112036-210112067
  hyper
cggcaaaccatccttccgcaatacccacctt

SEQ ID NO: 5884 - DNA, 30 bp, Homo sapiens
  chr1:211306755-211306785
  hyper
ggacctggagttgcccgtctctactgctgg

SEQ ID NO: 5885 - DNA, 30 bp, Homo sapiens
  chr1:211307339-211307369
  hyper
gcaggaaactggcctcggggcccgcacgca

SEQ ID NO: 5886 - DNA, 110 bp, Homo sapiens
  chr1:213124513-213124623
  hyper
gcctttctaggtaatcgcagggctggaagcccgtcatcgattctcagggaggctgtcagcgtgcaggggggagcggggagtgtcgtggagacactccgggacccctcact

SEQ ID NO: 5887 - DNA, 317 bp, Homo sapiens
  chr1:213124668-213124985
  hyper
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccac

SEQ ID NO: 5888 - DNA, 53 bp, Homo sapiens
  chr1:214155985-214156038
  hyper
ttccatcccttcaaacgtgcacgcccctcccgcggtcccgggagggagtcccc

SEQ ID NO: 5889 - DNA, 239 bp, Homo sapiens; identical to SEQ ID NO: 1870
  chr1:214156419-214156658
  hyper

SEQ ID NO: 5890 - DNA, 35 bp, Homo sapiens
  chr1:214156893-214156928
  hyper
actccccttgagttgcggcccgagactgcctttgt

SEQ ID NO: 5891 - DNA, 84 bp, Homo sapiens; identical to SEQ ID NO: 1871
  chr1:214158827-214158911
  hyper

SEQ ID NO: 5892 - DNA, 30 bp, Homo sapiens
  chr1:214160288-214160318
  hyper
ttattttagagcctgcgatttatgcgtttg

SEQ ID NO: 5893 - DNA, 136 bp, Homo sapiens
  chr1:214162493-214162629
  hyper
agggaggtgggggggcgctctgttactttcgtctcaaaacgctgtcgaagccgaattgtggaaatccggcttggaggggagcggtgatgggtcccgggaaacgcgcgcggcgcccctcttccgagctcctggaccc

SEQ ID NO: 5894 - DNA, 99 bp, Homo sapiens
  chr1:214360654-214360753
  hyper
agctaattgcctaatcggagtggggagctggtgcccgctcgccgcggtcgcctcgcgggtcacagacaagagagcggcttgttttctctctgtcacatc

SEQ ID NO: 5895 - DNA, 105 bp, Homo sapiens
  chr1:214360754-214360859
  hyper
tcgtcttgaaccgtgtggtctgttgcaggggaaggggccgagctggaggagcgagcgggcgggcggcgcttggcacatcccgaagaacgctgcctcggttgcctg

SEQ ID NO: 5896 - DNA, 96 bp, Homo sapiens
  chr1:214360926-214361022
  hyper
cgcgctctgctcagctctacccggctccgctctcaggcgtgtgctcagaacacaccgagatcctttagaaataaatgtaatcgagactaatctgga

SEQ ID NO: 5897 - DNA, 41 bp, Homo sapiens
  chr1:214387716-214387757
  hyper
gaactgccccagtggcgtctgcgaggcgtttcctctataaa

SEQ ID NO: 5898 - DNA, 810 bp, Homo sapiens; identical to SEQ ID NO: 117
  chr1:215255060-215255870
  hyper

SEQ ID NO: 5899 - DNA, 315 bp, Homo sapiens
  chr1:215256457-215256772
  hyper
gcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcagg

SEQ ID NO: 5900 - DNA, 42 bp, Homo sapiens
  chr1:216896512-216896554
  hyper
aagatatagtctgtccgcccccacccccgcacccccacgacg

SEQ ID NO: 5901 - DNA, 87 bp, Homo sapiens
  chr1:216896887-216896974
  hyper
caatcaggagggaggcgacgggaggctgcacggagcgagaggagccaggcaggtaggcagggtgcagagagccgaagggggctggaa

SEQ ID NO: 5902 - DNA, 504 bp, Homo sapiens; identical to SEQ ID NO: 1873
  chr1:217307502-217308006
  hyper

SEQ ID NO: 5903 - DNA, 75 bp, Homo sapiens
  chr1:217308622-217308697
  hyper
tttatgaaacacacacgcccaccccgcctcccacgtaaaggccagtcttgactcattttgcgcccagatgcaaac

SEQ ID NO: 5904 - DNA, 30 bp, Homo sapiens
  chr1:217309007-217309037
  hyper
taccagagggtgtttcggggctccccacgg

SEQ ID NO: 5905 - DNA, 48 bp, Homo sapiens
  chr1:217309258-217309306
  hyper
ccccttttctggggacgaccttactcccacccccgccccctttgcagt

SEQ ID NO: 5906 - DNA, 109 bp, Homo sapiens
  chr1:217311452-217311561
  hyper
ggcagaaatgacagacgcacgaacagcgtctctgtggctgtctgcagcgcgaggttcacgtctattgttttatgcctccgggagagctaccccgcgtgatagatctttt

SEQ ID NO: 5907 - DNA, 66 bp, Homo sapiens
  chr1:217311944-217312010
  hyper
gagaaaagaaaggagcgggaggaaggcacagtgggggcgggggacagtcgtcggacactagttaac

SEQ ID NO: 5908 - DNA, 18 bp, Homo sapiens
  chr1:217313025-217313043
  hyper
cccctctgcaattgccgg

SEQ ID NO: 5909 - DNA, 679 bp, Homo sapiens
  chr1:217313068-217313747
  hyper
gcagaggccggggacttcgggcgcttgctaggtcaccgcgccgggcgaccgccgctcgccggctatttaatatacatggggtgggaacggagcgaagcggatctccgagcctgcctgtcctgcagaaaaaaaaaatcaatttgctatttatttttgaaatatatagatttagggaatgttttttccagctcgacccccttcaagaatggcggcccacatttaattacgtcttttaatgacttttcccttatttgccatcgctattccacgttaagggcgggggcggggtggagtttctttggggggttttcaattctggtatcttcaaaaagatttgccttatgtgttaattgcatgctgttaagcacatctgggactgtgtgctgaccaactcagaccaacttttaattaacacattgacccggagaagaagcagccgcccagcctccccctctaaatatgtatattagccacgcggaggcggctcggcccgcgccgccagatgcaagcaaggaattgcctgcgtcgaggggcgggagggggtgcaaattgcaacggttctctctctttctgtgagcgttttttctcgcctcacctctaggaaaacaacaaagaaaaagagtaaatgaccggctcctgaatcaggcttcttacatcctttaggcgtgacttgacccca

SEQ ID NO: 5910 - DNA, 30 bp, Homo sapiens
  chr1:218337322-218337352
  hyper
acttctaaaacatttcgtggaagagagtag

SEQ ID NO: 5911 - DNA, 30 bp, Homo sapiens
  chr1:218337823-218337853
  hyper
ggtcatcagcaggaccgagaagactgggtg

SEQ ID NO: 5912 - DNA, 96 bp, Homo sapiens
  chr1:218338074-218338170
  hyper
cgccggacccctccccgctgcccggggtgcggcggcttccctccgcccaaacggggggtgtctcctccatcacccctgccgcggcttcccagtcgg

SEQ ID NO: 5913 - DNA, 124 bp, Homo sapiens
  chr1:218520127-218520251
  hyper
atggaccagttcatgcgcaagaggatcgaggcgatccgcgggcagatcctgagcaagctgaagctcaccagtcccccagaagactatcctgagcccgaggaagtccccccggaggtgatttcca

SEQ ID NO: 5914 - DNA, 94 bp, Homo sapiens; identical to SEQ ID NO: 1874
  chr1:220101117-220101211
  hyper

SEQ ID NO: 5915 - DNA, 239 bp, Homo sapiens; identical to SEQ ID NO: 1875
  chr1:220101370-220101609
  hyper

SEQ ID NO: 5916 - DNA, 83 bp, Homo sapiens
  chr1:220700814-220700897
  hyper
gagggtgctgcagggcgcccagagcgagacgtcttccgccggccccattcccgaagaggccgcgccgtcgggggctgagaccc

SEQ ID NO: 5917 - DNA, 200 bp, Homo sapiens
  chr1:220702265-220702465
  hyper
gatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctcc

SEQ ID NO: 5918 - DNA, 145 bp, Homo sapiens
  chr1:220921624-220921769
  hyper
cgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaac

SEQ ID NO: 5919 - DNA, 694 bp, Homo sapiens
  chr1:221052025-221052719
  hyper
ggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccg

SEQ ID NO: 5920 - DNA, 311 bp, Homo sapiens
  chr1:221053402-221053713
  hyper
ggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagca

SEQ ID NO: 5921 - DNA, 30 bp, Homo sapiens
  chr1:221067646-221067676
  hyper
gacctcggagagctgcgccgagcagggcgg

SEQ ID NO: 5922 - DNA, 121 bp, Homo sapiens
  chr1:223302777-223302898
  hyper
ggaaggccctgctcccgaccgacccggagcgcgctgctgccctctaccggtcatccgtgcggccggacaccgtgtcaggcccgcgaggagggctctgccgcagtcccggggaacagcaccc

SEQ ID NO: 5923 - DNA, 73 bp, Homo sapiens
  chr1:223538158-223538231
  hyper
agtctcttaatttcccgcgttaacccctccccgctcccatctccgccgaagctctgcgcgtccccagggagcc

SEQ ID NO: 5924 - DNA, 110 bp, Homo sapiens; identical to SEQ ID NO: 118
  chr1:223936643-223936753
  hyper

SEQ ID NO: 5925 - DNA, 62 bp, Homo sapiens; identical to SEQ ID NO: 119
  chr1:223936995-223937057
  hyper

SEQ ID NO: 5926 - DNA, 43 bp, Homo sapiens
  chr1:224528801-224528844
  hyper
gctccacctcctccccgtgccctccccacgaggcctgggagcg

SEQ ID NO: 5927 - DNA, 30 bp, Homo sapiens
  chr1:224803373-224803403
  hyper
ttgctgcctcttcagcgcagaatagcccac

SEQ ID NO: 5928 - DNA, 185 bp, Homo sapiens
  chr1:224804002-224804187
  hyper
caccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggtt

SEQ ID NO: 5929 - DNA, 62 bp, Homo sapiens; identical to SEQ ID NO: 120
  chr1:224804625-224804687
  hyper

SEQ ID NO: 5930 - DNA, 270 bp, Homo sapiens; identical to SEQ ID NO: 121
  chr1:224804846-224805116
  hyper

SEQ ID NO: 5931 - DNA, 555 bp, Homo sapiens; identical to SEQ ID NO: 122
  chr1:224805197-224805752
  hyper

SEQ ID NO: 5932 - DNA, 18 bp, Homo sapiens
  chr1:224805848-224805866
  hyper
cgccggtcctctcaaaga

SEQ ID NO: 5933 - DNA, 100 bp, Homo sapiens
  chr1:225117280-225117380
  hyper
ccctcctcacctgcccggcacccaggatcccttgcgccgcgttcgggaccccacccccattgtggcctcttcgccagggcgcaggcgtggctcttggtca

SEQ ID NO: 5934 - DNA, 41 bp, Homo sapiens
  chr1:226411183-226411224
  hyper
ctccctcctgcatcccgcagccggcggaagcgattattccc

SEQ ID NO: 5935 - DNA, 195 bp, Homo sapiens
  chr1:226411246-226411441
  hyper
cgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgta

SEQ ID NO: 5936 - DNA, 147 bp, Homo sapiens
  chr1:226411796-226411943
  hyper
aagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcat

SEQ ID NO: 5937 - DNA, 106 bp, Homo sapiens
  chr1:226737012-226737118
  hyper
tctccgacccgcaggcggggccccaaagagccggaaactttgcggccaatgttggagcccgcagcggcggccggaatggctctgccggcttcggagtagggctccc

SEQ ID NO: 5938 - DNA, 644 bp, Homo sapiens
  chr1:226924900-226925544
  hyper
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcg

SEQ ID NO: 5939 - DNA, 131 bp, Homo sapiens
  chr1:227730464-227730595
  hyper
gcgaagctgcctccccgcggggggagcggaagtggcccagctgctcgagtgacttactagttaaaaagctggggttggagctgccacgcggggaagtgtggaggcctgcggggctccgcctagactttctg

SEQ ID NO: 5940 - DNA, 33 bp, Homo sapiens
  chr1:228074787-228074820
  hyper
tgagaacattttttccgacgcagcccgcagcga

SEQ ID NO: 5941 - DNA, 87 bp, Homo sapiens
  chr1:228194270-228194357
  hyper
gcaagagacggagctcgccacagaccaggagcgagagggggactgcgggtcccaccgtgagcgcagggcgcgcggggctggaaaccc

SEQ ID NO: 5942 - DNA, 1554 bp, Homo sapiens; identical to SEQ ID NO: 124
  chr1:228194949-228196503
  hyper

SEQ ID NO: 5943 - DNA, 71 bp, Homo sapiens
  chr1:228225753-228225824
  hyper
ggtcagcacggcgcccggccgcgcgggccgcccggcggtgtcaggggccgtggccgcggtggggcgcgggc

SEQ ID NO: 5944 - DNA, 456 bp, Homo sapiens
  chr1:228463250-228463706
  hyper
gcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacac

SEQ ID NO: 5945 - DNA, 63 bp, Homo sapiens
  chr1:228603691-228603754
  hyper
tgcaatctcaacactcgcgaccccacgcagtggagatctacagactttcgcctacgccacggg

SEQ ID NO: 5946 - DNA, 186 bp, Homo sapiens
  chr1:228604123-228604309
  hyper
ggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggt

SEQ ID NO: 5947 - DNA, 65 bp, Homo sapiens
  chr1:228604515-228604580
  hyper
gtggaaggctctggacgagccggggacaggcgcagcgggtgctgactgggcggtggggaggatgt

SEQ ID NO: 5948 - DNA, 107 bp, Homo sapiens; identical to SEQ ID NO: 125
  chr1:228633813-228633920
  hyper

SEQ ID NO: 5949 - DNA, 29 bp, Homo sapiens
  chr1:228633921-228633950
  hyper
gcttctctgcagctgtacaccctgcactg

SEQ ID NO: 5950 - DNA, 157 bp, Homo sapiens; identical to SEQ ID NO: 127
  chr1:228633983-228634140
  hyper

SEQ ID NO: 5951 - DNA, 152 bp, Homo sapiens
  chr1:228645092-228645244
  hyper
ccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 5952 - DNA, 600 bp, Homo sapiens
  chr1:228645306-228645906
  hyper
gccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaagg

SEQ ID NO: 5953 - DNA, 153 bp, Homo sapiens
  chr1:228646206-228646359
  hyper
agtgaggcgttcctcggcgtcctgaacccaaaggctcttttcagagccacccacacgatcaagaaagggtttcgaacacggtgaagggttatgtaacctaatgtgtctccatgcaccctagcggttgccgggtgcggccgaatctgagccgtg

SEQ ID NO: 5954 - DNA, 74 bp, Homo sapiens
  chr1:228647217-228647291
  hyper
caggatgtttgataccgaatcgaagcacggcgtcaaagcagcgtcctgcgcgggggagccggatgtaataagcg

SEQ ID NO: 5955 - DNA, 470 bp, Homo sapiens; identical to SEQ ID NO: 128
  chr1:228651432-228651902
  hyper

SEQ ID NO: 5956 - DNA, 247 bp, Homo sapiens; identical to SEQ ID NO: 129
  chr1:228652206-228652453
  hyper

SEQ ID NO: 5957 - DNA, 34 bp, Homo sapiens; identical to SEQ ID NO: 130
  chr1:228652508-228652542
  hyper

SEQ ID NO: 5958 - DNA, 140 bp, Homo sapiens; identical to SEQ ID NO: 131
  chr1:229542813-229542953
  hyper

SEQ ID NO: 5959 - DNA, 124 bp, Homo sapiens; identical to SEQ ID NO: 132
  chr1:229543220-229543344
  hyper

SEQ ID NO: 5960 - DNA, 30 bp, Homo sapiens
  chr1:229566702-229566732
  hyper
cagcggaggccgccccggcagtgctggcaa

SEQ ID NO: 5961 - DNA, 86 bp, Homo sapiens; identical to SEQ ID NO: 133
  chr1:229567191-229567277
  hyper

SEQ ID NO: 5962 - DNA, 624 bp, Homo sapiens; identical to SEQ ID NO: 134
  chr1:229567369-229567993
  hyper

SEQ ID NO: 5963 - DNA, 193 bp, Homo sapiens; identical to SEQ ID NO: 135
  chr1:229568157-229568350
  hyper

SEQ ID NO: 5964 - DNA, 46 bp, Homo sapiens
  chr1:229570083-229570129
  hyper
ttgcccctcctgacccgacccagttgcccgccggaggggatggggt

SEQ ID NO: 5965 - DNA, 33 bp, Homo sapiens
  chr1:229570479-229570512
  hyper
caaaaagctgagccacgtcgaccccttccccca

SEQ ID NO: 5966 - DNA, 30 bp, Homo sapiens
  chr1:230561556-230561586
  hyper
tgtccgggccggactcgccgaacacgtcgt

SEQ ID NO: 5967 - DNA, 15 bp, Homo sapiens
  chr1:231296817-231296832
  hyper
cgctacgactccggt

SEQ ID NO: 5968 - DNA, 59 bp, Homo sapiens; identical to SEQ ID NO: 1894
  chr1:231297044-231297103
  hyper

SEQ ID NO: 5969 - DNA, 29 bp, Homo sapiens
  chr1:231297104-231297133
  hyper
cagctcgtggctggcgttggagaatgtgg

SEQ ID NO: 5970 - DNA, 364 bp, Homo sapiens
  chr1:231298191-231298555
  hyper
agccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggac

SEQ ID NO: 5971 - DNA, 30 bp, Homo sapiens
  chr1:231299494-231299524
  hyper
cgccgaggcagcctccgggcccactggcac

SEQ ID NO: 5972 - DNA, 36 bp, Homo sapiens
  chr1:234040283-234040319
  hyper
agaagggtggaggagcgcgtccggtgccccaaggct

SEQ ID NO: 5973 - DNA, 5 bp, Homo sapiens
  chr1:234040969-234040974
  hyper
aggct

SEQ ID NO: 5974 - DNA, 213 bp, Homo sapiens; identical to SEQ ID NO: 1897
  chr1:234041148-234041361
  hyper

SEQ ID NO: 5975 - DNA, 55 bp, Homo sapiens; identical to SEQ ID NO: 1898
  chr1:234041415-234041470
  hyper

SEQ ID NO: 5976 - DNA, 68 bp, Homo sapiens
  chr1:234349983-234350051
  hyper
aagtaggaggctgtgcgcgcgtgtgtgtggagtggctgcgcggccggggaggatgtgcgctgcagggc

SEQ ID NO: 5977 - DNA, 141 bp, Homo sapiens
  chr1:234350052-234350193
  hyper
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggc

SEQ ID NO: 5978 - DNA, 279 bp, Homo sapiens
  chr1:235812015-235812294
  hyper
tccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggc

SEQ ID NO: 5979 - DNA, 47 bp, Homo sapiens
  chr1:235812947-235812994
  hyper
gggcgcccacttacccggagcgggatcacgcgcgggcttcgtctgca

SEQ ID NO: 5980 - DNA, 130 bp, Homo sapiens; identical to SEQ ID NO: 1899
  chr1:235813667-235813797
  hyper

SEQ ID NO: 5981 - DNA, 26 bp, Homo sapiens
  chr1:235814009-235814035
  hyper
ggttctaggagcgactgctctccagg

SEQ ID NO: 5982 - DNA, 79 bp, Homo sapiens; identical to SEQ ID NO: 1901
  chr1:236227842-236227921
  hyper

SEQ ID NO: 5983 - DNA, 187 bp, Homo sapiens; identical to SEQ ID NO: 1902
  chr1:236228021-236228208
  hyper

SEQ ID NO: 5984 - DNA, 18 bp, Homo sapiens
  chr1:236228606-236228624
  hyper
acctcccgccttgggcgc

SEQ ID NO: 5985 - DNA, 50 bp, Homo sapiens; identical to SEQ ID NO: 1904
  chr1:236228705-236228755
  hyper

SEQ ID NO: 5986 - DNA, 31 bp, Homo sapiens
  chr1:236558486-236558517
  hyper
ggccagtccttcgctcgcagtctgtcccggg

SEQ ID NO: 5987 - DNA, 5 bp, Homo sapiens
  chr1:236558547-236558552
  hyper
cgccc

SEQ ID NO: 5988 - DNA, 42 bp, Homo sapiens
  chr1:236558782-236558824
  hyper
ggaggagggcaggggcgcgcagagccacggtttgctccaggc

SEQ ID NO: 5989 - DNA, 80 bp, Homo sapiens
  chr1:236559127-236559207
  hyper
ctcccagtccagccccgcgagcggctgctgaccgcccctcccgcgctcgccagggcccctgccccgcgtcagccaccgcg

SEQ ID NO: 5990 - DNA, 112 bp, Homo sapiens
  chr1:236559256-236559368
  hyper
cgggatgccaggttgagacacgtcctgcaaacctctggcagaaatgggcgcaagggggtggatttcgttttcgcctcccgggctttttctttctccccgctcacatgccttc

SEQ ID NO: 5991 - DNA, 49 bp, Homo sapiens; identical to SEQ ID NO: 136
  chr1:236849457-236849506
  hyper

SEQ ID NO: 5992 - DNA, 224 bp, Homo sapiens; identical to SEQ ID NO: 137
  chr1:237206511-237206735
  hyper

SEQ ID NO: 5993 - DNA, 313 bp, Homo sapiens
  chr1:239550788-239551101
  hyper
ggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaattt

SEQ ID NO: 5994 - DNA, 52 bp, Homo sapiens
  chr1:240161034-240161086
  hyper
cggccacaccctccccgcgacacccgcgatcgccccccaggactggcggccc

SEQ ID NO: 5995 - DNA, 259 bp, Homo sapiens
  chr1:240161122-240161381
  hyper
cgtcctgctcaggcaattcctcccgcgcgccccgtcggggaccgggcggggacgggagaaggaaaagggcccctggctccgggaccagggctccggagggtgccgggcggggagcggaacagggaacgggctggtggcggccccaagcgggagggacggaccgacacgcggccccctggcggccttgcgactcgccgacctgcggaacctcgtcgccgccctcacagccccgcggccaccgccgacccgggccggtccc

SEQ ID NO: 5996 - DNA, 626 bp, Homo sapiens; identical to SEQ ID NO: 138
  chr1:240254860-240255486
  hyper

SEQ ID NO: 5997 - DNA, 672 bp, Homo sapiens; identical to SEQ ID NO: 139
  chr1:240255487-240256159
  hyper

SEQ ID NO: 5998 - DNA, 117 bp, Homo sapiens; identical to SEQ ID NO: 1909
  chr1:240256663-240256780
  hyper

SEQ ID NO: 5999 - DNA, 26 bp, Homo sapiens
  chr1:240775287-240775313
  hyper
ttggtctcccgccgccgctttcagtt

SEQ ID NO: 6000 - DNA, 77 bp, Homo sapiens
  chr1:240775378-240775455
  hyper
cgagagcgcgccccgcgccgcgcggtcccaggctggctgctcctgcagatgtgaaaggagcccggagacttagctct

SEQ ID NO: 6001 - DNA, 57 bp, Homo sapiens
  chr1:241520455-241520512
  hyper
ctccgcttcttctcccggggactgggaccagccgagcgcgcgcgggagtcgagacgc

SEQ ID NO: 6002 - DNA, 87 bp, Homo sapiens
  chr1:241587106-241587193
  hyper
gcaggcagtcctgagcggccgctgccatcgcgccggctgcagcggaaaggtacaagcggtggcggcaggagccgctgtgggagcagc

SEQ ID NO: 6003 - DNA, 63 bp, Homo sapiens; identical to SEQ ID NO: 1910
  chr1:241587546-241587609
  hyper

SEQ ID NO: 6004 - DNA, 268 bp, Homo sapiens; identical to SEQ ID NO: 1911
  chr1:241587610-241587878
  hyper

SEQ ID NO: 6005 - DNA, 530 bp, Homo sapiens; identical to SEQ ID NO: 1912
  chr1:242686734-242687264
  hyper

SEQ ID NO: 6006 - DNA, 114 bp, Homo sapiens; identical to SEQ ID NO: 1913
  chr1:242687574-242687688
  hyper

SEQ ID NO: 6007 - DNA, 150 bp, Homo sapiens; identical to SEQ ID NO: 1914
  chr1:242688094-242688244
  hyper

SEQ ID NO: 6008 - DNA, 119 bp, Homo sapiens; identical to SEQ ID NO: 1915
  chr1:242688277-242688396
  hyper

SEQ ID NO: 6009 - DNA, 30 bp, Homo sapiens
  chr1:243053994-243054024
  hyper
tgccgctgatgggggcgggcagggcggaat

SEQ ID NO: 6010 - DNA, 30 bp, Homo sapiens
  chr1:244014641-244014671
  hyper
actttgggaaagccacgaggtactacattt

SEQ ID NO: 6011 - DNA, 325 bp, Homo sapiens
  chr1:244080470-244080795
  hyper
aacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggccggggagctccgccagcgcattgtgcgagcgagctgaatgcagccgaggggcgagcgcgcgggctcgcacggattagccgtgctttcccatgagccacaaaagaatgcccgaatctgggacatc

SEQ ID NO: 6012 - DNA, 44 bp, Homo sapiens
  chr1:244893555-244893599
  hyper
gctgcgaggaggacgcggctcgtttagctcgctgcgaacctcaa

SEQ ID NO: 6013 - DNA, 32 bp, Homo sapiens
  chr1:247171029-247171061
  hyper
cccggcccccacctgcgcgggacgggactgag

SEQ ID NO: 6014 - DNA, 52 bp, Homo sapiens
  chr1:247171365-247171417
  hyper
ccagatccccaaggccgccccttcctctctggctgcacgcctgattggacag

SEQ ID NO: 6015 - DNA, 23 bp, Homo sapiens
  chr1:247274349-247274372
  hyper
cggggccgcgagcaagcctccga

SEQ ID NO: 6016 - DNA, 116 bp, Homo sapiens; identical to SEQ ID NO: 140
  chr1:248020515-248020631
  hyper

SEQ ID NO: 6017 - DNA, 341 bp, Homo sapiens; identical to SEQ ID NO: 141
  chr1:248020956-248021297
  hyper

SEQ ID NO: 6018 - DNA, 30 bp, Homo sapiens
  chr2:287500-287530
  hyper
tgtctctttttgaaacgtgtttctcaaaga

SEQ ID NO: 6019 - DNA, 127 bp, Homo sapiens; identical to SEQ ID NO: 1918
  chr2:288404-288531
  hyper

SEQ ID NO: 6020 - DNA, 61 bp, Homo sapiens
  chr2:288738-288799
  hyper
tatccccgcgcccgccgacgtcaggcgggtccccaagggctccgagcggggctttaattag

SEQ ID NO: 6021 - DNA, 30 bp, Homo sapiens
  chr2:289223-289253
  hyper
caattagagtccatccgttttggagggatc

SEQ ID NO: 6022 - DNA, 235 bp, Homo sapiens
  chr2:290038-290273
  hyper
agatatgaaatgtgccggttccggaccccgccccacacccttgggatctgcgttctctccgctcccttgaaaaacagatggtttgatttcacagcgaggcttttctttttctttttgcaagctacatgactgaaatgtgaacatttctgctaaaatacactcaggaaaaagtaaaattttatgtcaaacagaccttaggcacataaaaggaggcatttttcgtttctctctttcc

SEQ ID NO: 6023 - DNA, 249 bp, Homo sapiens; identical to SEQ ID NO: 142
  chr2:468423-468672
  hyper

SEQ ID NO: 6024 - DNA, 165 bp, Homo sapiens; identical to SEQ ID NO: 1920
  chr2:945845-946010
  hyper

SEQ ID NO: 6025 - DNA, 207 bp, Homo sapiens; identical to SEQ ID NO: 1921
  chr2:946011-946218
  hyper

SEQ ID NO: 6026 - DNA, 115 bp, Homo sapiens; identical to SEQ ID NO: 1922
  chr2:946289-946404
  hyper

SEQ ID NO: 6027 - DNA, 51 bp, Homo sapiens
  chr2:947126-947177
  hyper
cggtggctcggaccggagcgtcccccctgcagccttcgggcgcccaggcca

SEQ ID NO: 6028 - DNA, 466 bp, Homo sapiens; identical to SEQ ID NO: 1923
  chr2:1746567-1747033
  hyper

SEQ ID NO: 6029 - DNA, 338 bp, Homo sapiens
  chr2:1747670-1748008
  hyper
gagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccgg

SEQ ID NO: 6030 - DNA, 94 bp, Homo sapiens
  chr2:1748454-1748548
  hyper
cccgcatggccaaggcgagcgctcgggggcgcggaggagagcattggcacccctgattctgcgctcgagactcggggctcgggaccctggggcc

SEQ ID NO: 6031 - DNA, 43 bp, Homo sapiens
  chr2:5831358-5831401
  hyper
tagctcacaatcgcacgatttcaggacgaggctgccggagaag

SEQ ID NO: 6032 - DNA, 259 bp, Homo sapiens; identical to SEQ ID NO: 1924
  chr2:5831789-5832048
  hyper

SEQ ID NO: 6033 - DNA, 116 bp, Homo sapiens; identical to SEQ ID NO: 1925
  chr2:5832731-5832847
  hyper

SEQ ID NO: 6034 - DNA, 151 bp, Homo sapiens; identical to SEQ ID NO: 1926
  chr2:5833282-5833433
  hyper

SEQ ID NO: 6035 - DNA, 141 bp, Homo sapiens; identical to SEQ ID NO: 1927
  chr2:5833499-5833640
  hyper

SEQ ID NO: 6036 - DNA, 75 bp, Homo sapiens; identical to SEQ ID NO: 1928
  chr2:5833953-5834028
  hyper

SEQ ID NO: 6037 - DNA, 87 bp, Homo sapiens; identical to SEQ ID NO: 1929
  chr2:5836085-5836172
  hyper

SEQ ID NO: 6038 - DNA, 78 bp, Homo sapiens
  chr2:5836497-5836575
  hyper
agggggcgcggggcgcggcgggacccaggctacgagcgggagggaggcgggagtcgggggaagacgcggcaggccggc

SEQ ID NO: 6039 - DNA, 125 bp, Homo sapiens
  chr2:5836851-5836976
  hyper
cggggagggaagcctcggggctgcggggtgagaggaagaaagcaaacccggggagcaggcggctgccgcacccgcgcaccccgggccctcaccacgccctccccgcgcgccggctcaggggctgc

SEQ ID NO: 6040 - DNA, 116 bp, Homo sapiens
  chr2:5837352-5837468
  hyper
cggaggaggttttcagtggctgattgaaactcactgcaaaatcaccacgactctttcacctactgagatgattgaccgaggtttggccttccatttttactgagatttggcgagac

SEQ ID NO: 6041 - DNA, 104 bp, Homo sapiens; identical to SEQ ID NO: 1930
  chr2:5866074-5866178
  hyper

SEQ ID NO: 6042 - DNA, 53 bp, Homo sapiens
  chr2:7058223-7058276
  hyper
aggtctgggaaaggacgacgcgtccggggcatcgccaccggcggggaaggtcg

SEQ ID NO: 6043 - DNA, 30 bp, Homo sapiens
  chr2:7571320-7571350
  hyper
tacatttcaaatgctcgacagctgggccaa

SEQ ID NO: 6044 - DNA, 45 bp, Homo sapiens
  chr2:7571610-7571655
  hyper
caggtgtgcactccgcgcgcgcactcagctcgctttggtgtttct

SEQ ID NO: 6045 - DNA, 206 bp, Homo sapiens
  chr2:10182790-10182996
  hyper
agagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccaga

SEQ ID NO: 6046 - DNA, 118 bp, Homo sapiens
  chr2:10220823-10220941
  hyper
gggcccgtgggaggccgcgggagcttggggggacttcccaaagcctgagccccctagcgatgcgcggggtgggcgggggaaagaccctgagggctgcgcgcgctgcgttcgcgaggtc

SEQ ID NO: 6047 - DNA, 15 bp, Homo sapiens
  chr2:10220958-10220973
  hyper
cgacctttcagtgtc

SEQ ID NO: 6048 - DNA, 30 bp, Homo sapiens
  chr2:10688849-10688879
  hyper
tctgctgggatgacccggtcctgttgcccc

SEQ ID NO: 6049 - DNA, 30 bp, Homo sapiens
  chr2:11052420-11052450
  hyper
cccgcaggcgggcgccggccaggctctccc

SEQ ID NO: 6050 - DNA, 157 bp, Homo sapiens
  chr2:11622808-11622965
  hyper
gccaagcccaccgcccggccctcctccgcggccgtcccgaagacccggagaagtggaccacagggggcggccagtgtcaggggtcgagtcctccgcgctggccgcggttccggagatccgggctttgccgagcgccccgcgccgtggccggggccgg

SEQ ID NO: 6051 - DNA, 91 bp, Homo sapiens
  chr2:12858539-12858630
  hyper
gccagagtttcagcccgaacctcggctccccgagcccgcccgagactccgaacttgtcgcattgcgtttcttgtatcgggaaatacttatt

SEQ ID NO: 6052 - DNA, 30 bp, Homo sapiens
  chr2:14773957-14773987
  hyper
ggcacgtaagctagccggcaggtcccaggg

SEQ ID NO: 6053 - DNA, 516 bp, Homo sapiens
  chr2:16082386-16082902
  hyper
cgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgccc

SEQ ID NO: 6054 - DNA, 71 bp, Homo sapiens
  chr2:17720246-17720317
  hyper
gcagcccgccggggccgcgcgccgtggtccgcgcgactccgcgctccgggtttccgcggtcaccagcactg

SEQ ID NO: 6055 - DNA, 56 bp, Homo sapiens
  chr2:17721623-17721679
  hyper
aaccactgggcgtggcgagtccgggtaacccgcagtccctcgcgcccgtccaggtg

SEQ ID NO: 6056 - DNA, 74 bp, Homo sapiens
  chr2:17721750-17721824
  hyper
cgtggaatccacccgcggaaactccgagcccctccgactgagcatgcgccatcgccaggcggcttttggtcaca

SEQ ID NO: 6057 - DNA, 126 bp, Homo sapiens
  chr2:18011883-18012009
  hyper
actggctgcagatcccgcaaccctcgggtgttcaagtgcgcggggtggtgcgggcgctcccgcagtccgcgcttggctcgtgggaggcctcgggcgccccctccaggattccgtgctaactgcaaa

SEQ ID NO: 6058 - DNA, 584 bp, Homo sapiens
  chr2:18058949-18059533
  hyper
ccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccg

SEQ ID NO: 6059 - DNA, 30 bp, Homo sapiens
  chr2:18060088-18060118
  hyper
ccccacctccctgcgcgctccggagacttc

SEQ ID NO: 6060 - DNA, 43 bp, Homo sapiens
  chr2:19551406-19551449
  hyper
tgcagaccccaggcccgaggtccccgtcccgctctcctagtcc

SEQ ID NO: 6061 - DNA, 254 bp, Homo sapiens
  chr2:19556346-19556600
  hyper
tccggtttcccagaccgcggaaccccagggcgaatactttcgatctttaaacacaggatggaaaacccttccccaggctaggcacccattcctcaaacagcttgggcctcaggacctgcgggaaagaataaggggacccgaccacgcacagcagacgcaattcgcgctcgggatcccgagtccctgcgcagtgcgggcactcgcgtccctcgcgcggtggagcgccaatcccaggtctgcggccagtcctatgc

SEQ ID NO: 6062 - DNA, 156 bp, Homo sapiens
  chr2:19558809-19558965
  hyper
cggcttgggtttcaacgcactttggcgcctgacagagtcgcatctcctcccagaatctctttccagaggcggcagaccccgagtgtggagcagctcctggctatccaagcgtgctcggggccagggtgttaacccaggcagcgctggttaattcct

SEQ ID NO: 6063 - DNA, 32 bp, Homo sapiens
  chr2:19561263-19561295
  hyper
agcgcactccgccaccgcggctgcagcttctg

SEQ ID NO: 6064 - DNA, 52 bp, Homo sapiens
  chr2:19561523-19561575
  hyper
cgatccctccgtctgcccgggcttccgggctgtggaccgcactgaacccagt

SEQ ID NO: 6065 - DNA, 30 bp, Homo sapiens
  chr2:20068798-20068828
  hyper
cttctctaactgacccgaaccgacccgggc

SEQ ID NO: 6066 - DNA, 133 bp, Homo sapiens; identical to SEQ ID NO: 1931
  chr2:20865714-20865847
  hyper

SEQ ID NO: 6067 - DNA, 232 bp, Homo sapiens; identical to SEQ ID NO: 1932
  chr2:20865848-20866080
  hyper

SEQ ID NO: 6068 - DNA, 65 bp, Homo sapiens
  chr2:21022991-21023056
  hyper
cctcttggagggtgtcggggttttcctttctttttcatttgaattttatccgccttttattttct

SEQ ID NO: 6069 - DNA, 41 bp, Homo sapiens
  chr2:23609527-23609568
  hyper
ctccgtggcctggagcgggctgagagcgctagggttatctg

SEQ ID NO: 6070 - DNA, 16 bp, Homo sapiens
  chr2:24232773-24232789
  hyper
gtcctgagggcctgcc

SEQ ID NO: 6071 - DNA, 89 bp, Homo sapiens
  chr2:24233349-24233438
  hyper
gcaggtcctcccggggtccccgagctctgggcaggcagggctttctgaagcgcctggggaggctgcgtccttcccgacctcaggcagct

SEQ ID NO: 6072 - DNA, 30 bp, Homo sapiens
  chr2:24273201-24273231
  hyper
tcggtcgcttccctgcgggccgggctgtga

SEQ ID NO: 6073 - DNA, 42 bp, Homo sapiens
  chr2:25354748-25354790
  hyper
catgttccaggaggccgtcatcaagaccgtgggtgcggcgcg

SEQ ID NO: 6074 - DNA, 676 bp, Homo sapiens; identical to SEQ ID NO: 1933
  chr2:25391058-25391734
  hyper

SEQ ID NO: 6075 - DNA, 37 bp, Homo sapiens; identical to SEQ ID NO: 143
  chr2:25438835-25438872
  hyper

SEQ ID NO: 6076 - DNA, 222 bp, Homo sapiens; identical to SEQ ID NO: 144
  chr2:25439138-25439360
  hyper

SEQ ID NO: 6077 - DNA, 249 bp, Homo sapiens
  chr2:26401931-26402180
  hyper
gtggagggaggaggacggcgactcgcgccgggtggggctgaaggcactgcggggtgactcggtctccaggctgcggcgctctgctccgggagtcagggagacctggcctggccccgtactgtcccccgtcccagcccccgcccctggccctgcgggaggggccaggcgtcttccctgagcatggtgccacttccccagtgttggccttgtttcctgctcagcatttggcagatgcgcctctggcccaac

SEQ ID NO: 6078 - DNA, 179 bp, Homo sapiens; identical to SEQ ID NO: 145
  chr2:26407743-26407922
  hyper

SEQ ID NO: 6079 - DNA, 103 bp, Homo sapiens; identical to SEQ ID NO: 1937
  chr2:26522016-26522119
  hyper

SEQ ID NO: 6080 - DNA, 372 bp, Homo sapiens
  chr2:26915695-26916067
  hyper
ggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctggg

SEQ ID NO: 6081 - DNA, 89 bp, Homo sapiens
  chr2:26916088-26916177
  hyper
cggggccggctggggctgggggcgggggctcccccgagaggggctgggcgccgaaccctgcgctcgcagaaacccgagttcagcctggc

SEQ ID NO: 6082 - DNA, 806 bp, Homo sapiens; identical to SEQ ID NO: 1938
  chr2:27070324-27071130
  hyper

SEQ ID NO: 6083 - DNA, 97 bp, Homo sapiens
  chr2:27071758-27071855
  hyper
ccgagccgggtccctcggctggagcccagcgcgggagcccgccttgcagcatcgatctcagcgggcaccgacgtcgacgccccgggcctggggacgg

SEQ ID NO: 6084 - DNA, 70 bp, Homo sapiens
  chr2:27072945-27073015
  hyper
tttctcagggggagccgtaagggctggtgcggattgtggtcaaattgcggagaagcgggtggaaatgatc

SEQ ID NO: 6085 - DNA, 30 bp, Homo sapiens
  chr2:27473328-27473358
  hyper
tcctcttgaccctgccggctgggccctggg

SEQ ID NO: 6086 - DNA, 159 bp, Homo sapiens
  chr2:27484899-27485058
  hyper
agacaagatggcccacgggggtgggcagggaggtcggacggccgctcagaggggcaggtggacggtggcggcaggcgcgggggccggcggggcgcgttggcggttctcctgccacccccggcccgctgtcccggccgctccgcgcgcctcatttcacac

SEQ ID NO: 6087 - DNA, 86 bp, Homo sapiens
  chr2:27938325-27938411
  hyper
gggggcaggcctggccgagtggctccgtgaagacgcaggcgcggccggagggcgcggggctcgggcaggatcgcgccgccgggccg

SEQ ID NO: 6088 - DNA, 170 bp, Homo sapiens; identical to SEQ ID NO: 1939
  chr2:29033528-29033698
  hyper

SEQ ID NO: 6089 - DNA, 590 bp, Homo sapiens; identical to SEQ ID NO: 1940
  chr2:29338158-29338748
  hyper

SEQ ID NO: 6090 - DNA, 281 bp, Homo sapiens; identical to SEQ ID NO: 1941
  chr2:29338809-29339090
  hyper

SEQ ID NO: 6091 - DNA, 47 bp, Homo sapiens
  chr2:30143276-30143323
  hyper
gccagccttcagctccgaggaggatggtggcagcagtaggtcccggg

SEQ ID NO: 6092 - DNA, 82 bp, Homo sapiens
  chr2:30143382-30143464
  hyper
cgcgagtagctgagtggctcccggggctgcagcggcggccccgcagctggggagcccgcgcgctggccggtccccatcccgg

SEQ ID NO: 6093 - DNA, 201 bp, Homo sapiens
  chr2:30144378-30144579
  hyper
ccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 6094 - DNA, 279 bp, Homo sapiens; identical to SEQ ID NO: 146
  chr2:30453784-30454063
  hyper

SEQ ID NO: 6095 - DNA, 381 bp, Homo sapiens
  chr2:31360209-31360590
  hyper
ccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgag

SEQ ID NO: 6096 - DNA, 63 bp, Homo sapiens
  chr2:31360630-31360693
  hyper
cgcgggtccggagatgcccccgagcgttttaaaatccagaaacatcacatggtagccacatcc

SEQ ID NO: 6097 - DNA, 62 bp, Homo sapiens
  chr2:31360694-31360756
  hyper
gcggctgttacctgctcgcagcacccagaccctcgccctggtttcccgggagcccgcaaacc

SEQ ID NO: 6098 - DNA, 176 bp, Homo sapiens
  chr2:31360803-31360979
  hyper
cgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcg

SEQ ID NO: 6099 - DNA, 73 bp, Homo sapiens
  chr2:31361425-31361498
  hyper
ccaggtgggagtgagcggggctctgagagggggcgctaccgccgcccgccgaccgaaacgctcggtgctgttg

SEQ ID NO: 6100 - DNA, 185 bp, Homo sapiens
  chr2:31456872-31457057
  hyper
tgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgt

SEQ ID NO: 6101 - DNA, 45 bp, Homo sapiens
  chr2:37571852-37571897
  hyper
gctcccagacagactcggagagatggcaggcggaagacaccggcg

SEQ ID NO: 6102 - DNA, 99 bp, Homo sapiens
  chr2:38301762-38301861
  hyper
cggtgcgcaccgggttggggaagtactgcagccagggcatcacgtccaccaggctgcccgcgcccaccgtgcgcccgaactcttcgttgtggctgagca

SEQ ID NO: 6103 - DNA, 158 bp, Homo sapiens; identical to SEQ ID NO: 147
  chr2:38302718-38302876
  hyper

SEQ ID NO: 6104 - DNA, 47 bp, Homo sapiens
  chr2:38755384-38755431
  hyper
gccgctgtgattgggcgaaagatggcgctgggcggatggaaatccta

SEQ ID NO: 6105 - DNA, 38 bp, Homo sapiens; identical to SEQ ID NO: 148
  chr2:39187200-39187238
  hyper

SEQ ID NO: 6106 - DNA, 63 bp, Homo sapiens; identical to SEQ ID NO: 149
  chr2:39187544-39187607
  hyper

SEQ ID NO: 6107 - DNA, 781 bp, Homo sapiens
  chr2:39893060-39893841
  hyper
tgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcct

SEQ ID NO: 6108 - DNA, 392 bp, Homo sapiens; identical to SEQ ID NO: 150
  chr2:40678497-40678889
  hyper

SEQ ID NO: 6109 - DNA, 137 bp, Homo sapiens; identical to SEQ ID NO: 151
  chr2:40678949-40679086
  hyper

SEQ ID NO: 6110 - DNA, 432 bp, Homo sapiens; identical to SEQ ID NO: 152
  chr2:40679087-40679519
  hyper

SEQ ID NO: 6111 - DNA, 85 bp, Homo sapiens; identical to SEQ ID NO: 153
  chr2:40679520-40679605
  hyper

SEQ ID NO: 6112 - DNA, 68 bp, Homo sapiens
  chr2:42329377-42329445
  hyper
gtctgcagatggggccggccaccacgtgctctctgagttctctttccaagtacagatccctccggaga

SEQ ID NO: 6113 - DNA, 31 bp, Homo sapiens
  chr2:42329493-42329524
  hyper
cgtgagaaccggagcccggggtgacttgcgg

SEQ ID NO: 6114 - DNA, 86 bp, Homo sapiens
  chr2:42329751-42329837
  hyper
ccttgcagcgagatccgcgcccccccccaccccaccccgcctcattctccacaggcgccacagccacaggccgcataaataaatcc

SEQ ID NO: 6115 - DNA, 177 bp, Homo sapiens; identical to SEQ ID NO: 1950
  chr2:42720270-42720447
  hyper

SEQ ID NO: 6116 - DNA, 73 bp, Homo sapiens
  chr2:42720975-42721048
  hyper
ccctctcccaagccgcggggccgaccccctgagggctgcgggcgccgaatggagccgccggggcggaatagct

SEQ ID NO: 6117 - DNA, 84 bp, Homo sapiens
  chr2:43019673-43019757
  hyper
catgactgtcccgggcgcctcctcgcagcgctgtcctcccgccgtcggaggcccgcagctccgcccagccgcctttttaaccag

SEQ ID NO: 6118 - DNA, 212 bp, Homo sapiens
  chr2:43020113-43020325
  hyper
ctacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 6119 - DNA, 30 bp, Homo sapiens
  chr2:43451091-43451121
  hyper
aagtcccaaactcatcggagtcctaacaaa

SEQ ID NO: 6120 - DNA, 265 bp, Homo sapiens
  chr2:43452060-43452325
  hyper
agagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccatagggg

SEQ ID NO: 6121 - DNA, 119 bp, Homo sapiens; identical to SEQ ID NO: 154
  chr2:45028940-45029059
  hyper

SEQ ID NO: 6122 - DNA, 184 bp, Homo sapiens; identical to SEQ ID NO: 155
  chr2:45029183-45029367
  hyper

SEQ ID NO: 6123 - DNA, 86 bp, Homo sapiens; identical to SEQ ID NO: 156
  chr2:45155125-45155211
  hyper

SEQ ID NO: 6124 - DNA, 636 bp, Homo sapiens; identical to SEQ ID NO: 157
  chr2:45155355-45155991
  hyper

SEQ ID NO: 6125 - DNA, 820 bp, Homo sapiens; identical to SEQ ID NO: 158
  chr2:45155992-45156812
  hyper

SEQ ID NO: 6126 - DNA, 89 bp, Homo sapiens; identical to SEQ ID NO: 159
  chr2:45156832-45156921
  hyper

SEQ ID NO: 6127 - DNA, 96 bp, Homo sapiens; identical to SEQ ID NO: 160
  chr2:45157254-45157350
  hyper

SEQ ID NO: 6128 - DNA, 84 bp, Homo sapiens
  chr2:45157562-45157646
  hyper
ttctgctgaggaaggcgcaggcaaccctagtcggcttagagagagacaaccgcacgcgatcaccgagcacgatttctcccaaca

SEQ ID NO: 6129 - DNA, 214 bp, Homo sapiens
  chr2:45159704-45159918
  hyper
gagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctt

SEQ ID NO: 6130 - DNA, 64 bp, Homo sapiens
  chr2:45160203-45160267
  hyper
gctcctacctcaacacgcagcgctcagcgggctgccagagtgagcttcccggaccacccccaag

SEQ ID NO: 6131 - DNA, 38 bp, Homo sapiens; identical to SEQ ID NO: 1958
  chr2:45160596-45160634
  hyper

SEQ ID NO: 6132 - DNA, 30 bp, Homo sapiens
  chr2:45160939-45160969
  hyper
gatccgtattggcagcgacgaggaagggag

SEQ ID NO: 6133 - DNA, 34 bp, Homo sapiens
  chr2:45161221-45161255
  hyper
gagaggatggggaaacgcgcgccccaagagcaaa

SEQ ID NO: 6134 - DNA, 313 bp, Homo sapiens
  chr2:45161723-45162036
  hyper
gtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgcc

SEQ ID NO: 6135 - DNA, 124 bp, Homo sapiens
  chr2:45162037-45162161
  hyper
taaacccccacacaaaggctgcccggccaccgggtcccctgtcccccttcccggggacttcggcttttgaggtgctgctgcgcgttctttctccctccccctctcagggcgccagggcccagac

SEQ ID NO: 6136 - DNA, 30 bp, Homo sapiens
  chr2:45162908-45162938
  hyper
gcctctcctgccagccgtgtggctcttaaa

SEQ ID NO: 6137 - DNA, 205 bp, Homo sapiens
  chr2:45164939-45165144
  hyper
gtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcgg

SEQ ID NO: 6138 - DNA, 30 bp, Homo sapiens
  chr2:45165564-45165594
  hyper
gctgacctatccacccgagactctccgctc

SEQ ID NO: 6139 - DNA, 61 bp, Homo sapiens
  chr2:45168959-45169020
  hyper
tctccctctctgtctcgggttctctctctgcgcgcgcgcaccgggccgctctcctacctcc

SEQ ID NO: 6140 - DNA, 88 bp, Homo sapiens
  chr2:45169316-45169404
  hyper
gctccatacttctggcgagtagcggcggcgggaacggtgcgggaggcggcggcggcgcgggaggcggcagcggcggcgggaacggtgc

SEQ ID NO: 6141 - DNA, 341 bp, Homo sapiens
  chr2:45169782-45170123
  hyper
gcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctag

SEQ ID NO: 6142 - DNA, 240 bp, Homo sapiens; identical to SEQ ID NO: 161
  chr2:45171324-45171564
  hyper

SEQ ID NO: 6143 - DNA, 43 bp, Homo sapiens; identical to SEQ ID NO: 162
  chr2:45171836-45171879
  hyper

SEQ ID NO: 6144 - DNA, 400 bp, Homo sapiens
  chr2:45176601-45177001
  hyper
ctttgggcggggagacggttcagtgaggcagcgggaaggcccttgcctgggcttgccgagggggctgtgatggtggagtggcccccaggttcttctgcaaggagaataggacagcctggtacattctcgacccagcgcatcacccgggaccccggagctcgaagtccattcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacg

SEQ ID NO: 6145 - DNA, 622 bp, Homo sapiens
  chr2:45179362-45179984
  hyper
tccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccggcctgtggctgggcccgcactgcctttggtttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgtgtgtctgagctgaagcggctacgcttataccgggaggtgaaacgg

SEQ ID NO: 6146 - DNA, 152 bp, Homo sapiens; identical to SEQ ID NO: 1961
  chr2:45181520-45181672
  hyper

SEQ ID NO: 6147 - DNA, 88 bp, Homo sapiens
  chr2:45181913-45182001
  hyper
agtggaagcgtggcccgtgagaagggtaccgagggtcagaagtgtcgcaagggacccaggacgcgcgcgcctccgaacccctgagtct

SEQ ID NO: 6148 - DNA, 15 bp, Homo sapiens
  chr2:45231136-45231151
  hyper
attctgattttatcc

SEQ ID NO: 6149 - DNA, 76 bp, Homo sapiens
  chr2:45231244-45231320
  hyper
cgcccggccgcggtgccctggtcgctgagggacgcggtcagtacctaccgccactgcgacccgagaagggaaagcc

SEQ ID NO: 6150 - DNA, 143 bp, Homo sapiens
  chr2:45231852-45231995
  hyper
gtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtaccc

SEQ ID NO: 6151 - DNA, 30 bp, Homo sapiens
  chr2:45233569-45233599
  hyper
gccgctgccattcagcgggttgtggctgtt

SEQ ID NO: 6152 - DNA, 397 bp, Homo sapiens
  chr2:45235529-45235926
  hyper
gaaaggcctaagcatcgtccaagtcaggccgggctgccgctgggctgtggccgggcctgggggcccagtttaggcctctccgggggaccggcagaagccctgcgaacccctcccttgggccccggggagctggcgccgaagaaggtctacttactcgtacctttccttggcctcggccgcccggtcgcgctgccgccggttcttgaaccagttgctgacctgtgtggtggtgaggcccgtggcctccgccagctcacgcttctcgcggggtgaagggtaggggttgtgcgcgtaccactcgcgcagcacgctgcgactcttttccttgaagcagtagctggtctcctcgccgtcccagatggagcgcggcagcgggaatttgcggcgcacgcggtat

SEQ ID NO: 6153 - DNA, 38 bp, Homo sapiens
  chr2:45236204-45236242
  hyper
cgccacttgctcctgcgtgaagccgaaggtgggcagca

SEQ ID NO: 6154 - DNA, 64 bp, Homo sapiens
  chr2:45236460-45236524
  hyper
cctggcccaagccctcgcccaagcccgggggccgcccggggcgccgctccgcatgctccgcgcc

SEQ ID NO: 6155 - DNA, 27 bp, Homo sapiens
  chr2:45237662-45237689
  hyper
gtggtggggcttccccggtgggtggtc

SEQ ID NO: 6156 - DNA, 2 bp, Homo sapiens
  chr2:45237690-45237692
  hyper
gg

SEQ ID NO: 6157 - DNA, 15 bp, Homo sapiens
  chr2:45240616-45240631
  hyper
cggtctgtcgggtcc

SEQ ID NO: 6158 - DNA, 406 bp, Homo sapiens; identical to SEQ ID NO: 1963
  chr2:45240763-45241169
  hyper

SEQ ID NO: 6159 - DNA, 215 bp, Homo sapiens; identical to SEQ ID NO: 1964
  chr2:45241232-45241447
  hyper

SEQ ID NO: 6160 - DNA, 30 bp, Homo sapiens
  chr2:45241753-45241783
  hyper
agctgggaagtgacccggccaataggagaa

SEQ ID NO: 6161 - DNA, 66 bp, Homo sapiens
  chr2:45395854-45395920
  hyper
ttgtattttgagaaccgctccctttcccgcacacgcattgctgcctcctctcgggcttggttaatg

SEQ ID NO: 6162 - DNA, 209 bp, Homo sapiens
  chr2:45396160-45396369
  hyper
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgag

SEQ ID NO: 6163 - DNA, 268 bp, Homo sapiens
  chr2:45396672-45396940
  hyper
ccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctc

SEQ ID NO: 6164 - DNA, 33 bp, Homo sapiens
  chr2:45397223-45397256
  hyper
gcgattcccggctgtcggcggtggggctaggcc

SEQ ID NO: 6165 - DNA, 259 bp, Homo sapiens
  chr2:47748235-47748494
  hyper
agctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaaga

SEQ ID NO: 6166 - DNA, 723 bp, Homo sapiens; identical to SEQ ID NO: 1965
  chr2:47796765-47797488
  hyper

SEQ ID NO: 6167 - DNA, 474 bp, Homo sapiens; identical to SEQ ID NO: 1966
  chr2:47797489-47797963
  hyper

SEQ ID NO: 6168 - DNA, 1069 bp, Homo sapiens; identical to SEQ ID NO: 1967
  chr2:47797964-47799033
  hyper

SEQ ID NO: 6169 - DNA, 56 bp, Homo sapiens; identical to SEQ ID NO: 1968
  chr2:47799123-47799179
  hyper

SEQ ID NO: 6170 - DNA, 119 bp, Homo sapiens
  chr2:48982582-48982701
  hyper
gaaggtggcatagagcgatggagggtcctgcatcaagggcgccgcgacgggagcgctgtgtactcacagtcgagtgagaccggccgtggggccggggcagcgcagggcgccgtcgggca

SEQ ID NO: 6171 - DNA, 113 bp, Homo sapiens
  chr2:48982753-48982866
  hyper
cggctgcagcagcagcagcagcttcagcagctgcagcgccgagaaccgctgcttcatggccggcgaactgggcttctgcggcttgccagtgtcttggacggcctctgagtgcg

SEQ ID NO: 6172 - DNA, 132 bp, Homo sapiens; identical to SEQ ID NO: 1969
  chr2:50573507-50573639
  hyper

SEQ ID NO: 6173 - DNA, 87 bp, Homo sapiens; identical to SEQ ID NO: 1970
  chr2:50573691-50573778
  hyper

SEQ ID NO: 6174 - DNA, 95 bp, Homo sapiens; identical to SEQ ID NO: 1971
  chr2:50574218-50574313
  hyper

SEQ ID NO: 6175 - DNA, 54 bp, Homo sapiens; identical to SEQ ID NO: 163
  chr2:50574631-50574685
  hyper

SEQ ID NO: 6176 - DNA, 121 bp, Homo sapiens; identical to SEQ ID NO: 164
  chr2:50574738-50574859
  hyper

SEQ ID NO: 6177 - DNA, 71 bp, Homo sapiens
  chr2:56149951-56150022
  hyper
cccagtcccacaccccgggggatggaggtggggctgcaaaactctgttctctagaacgttaaggctttccc

SEQ ID NO: 6178 - DNA, 128 bp, Homo sapiens
  chr2:56150227-56150355
  hyper
aaagtggcatttccacgcctttctctgcgcacagctttgtttaaaagtcccaggttgtgtggaggggcagcccaaagcgactgattctcttttgtcttatcagtctgggtccccgacacgctaccttc

SEQ ID NO: 6179 - DNA, 36 bp, Homo sapiens
  chr2:56150770-56150806
  hyper
cccacctcactctcccgcgcgcggcccagtgagtac

SEQ ID NO: 6180 - DNA, 63 bp, Homo sapiens
  chr2:56411703-56411766
  hyper
cttcgggagtcgcctcgcctcttccacccacttgcacctgccaccccgcggataccatgtcga

SEQ ID NO: 6181 - DNA, 34 bp, Homo sapiens
  chr2:58655503-58655537
  hyper
gtttacatttggcagcgcccgggctgcgccgacc

SEQ ID NO: 6182 - DNA, 199 bp, Homo sapiens
  chr2:58655998-58656197
  hyper
gcgcgccactcagcccgggaggtggggccgggcagtgaccccgcgcgaagtgccagtgcggagggcgggggtggttaccgaaagatgtaatcccaggaggggccgccgccttcgctgtcccctacctgtaccctctctttatcctaccctccattccccgacccttttctccctctcttctccccgttcttttctactc

SEQ ID NO: 6183 - DNA, 264 bp, Homo sapiens
  chr2:60797078-60797342
  hyper
cttgtgtagagcctccggtgccctccacctaaccctgccccaatgcctcgggtcttttttgaactaatgctgtgcgtctccgcaatctgcaattactttggatatttctcaggagctaaacgcagcctgaatttcgtggcgcgtgcaaaaaaaaaaaaaaaggcgaaattaacaaaaccccaccaccgcgctgttgtttttttctggagtttttttttttttttttttttagttcggttcagaagcaaacgctacctagtttct

SEQ ID NO: 6184 - DNA, 276 bp, Homo sapiens
  chr2:60962755-60963031
  hyper
cagctcttggcggtgcgccacaggaactctccggtggtcgggttgtagatgaagagcttccactcggcgaggctctggttgagggactccttcttcatcgtgtgcgcgcggacgacgaggggagcggcggccgcggggacggaggcggcgagggcagcggggacgggggcggcgagggcagcggggacggaggaggcgagggcagcggaggcgcgtcccggctccggcggcgcagcccggcgacggcaggggagggtgggacgaccgagaacacct

SEQ ID NO: 6185 - DNA, 30 bp, Homo sapiens
  chr2:62798382-62798412
  hyper
gccgcgtgactcacccgtgtccctcgctct

SEQ ID NO: 6186 - DNA, 147 bp, Homo sapiens; identical to SEQ ID NO: 165
  chr2:63275877-63276024
  hyper

SEQ ID NO: 6187 - DNA, 67 bp, Homo sapiens
  chr2:63276425-63276492
  hyper
gatcaacaaaagaaccgaccaaagccttattaaaggtcctaagaagatctcccgggtcctttgagaa

SEQ ID NO: 6188 - DNA, 291 bp, Homo sapiens
  chr2:63278731-63279022
  hyper
agtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcag

SEQ ID NO: 6189 - DNA, 699 bp, Homo sapiens; identical to SEQ ID NO: 166
  chr2:63280952-63281651
  hyper

SEQ ID NO: 6190 - DNA, 91 bp, Homo sapiens
  chr2:63284752-63284843
  hyper
tttttagtgcaccttcgttctccgaaatctgcggagagcccgcgcgcctgtgtatcaattttggctttggccgcttcgtccagtaggtggg

SEQ ID NO: 6191 - DNA, 493 bp, Homo sapiens; identical to SEQ ID NO: 167
  chr2:63285117-63285610
  hyper

SEQ ID NO: 6192 - DNA, 227 bp, Homo sapiens; identical to SEQ ID NO: 168
  chr2:63286358-63286585
  hyper

SEQ ID NO: 6193 - DNA, 55 bp, Homo sapiens; identical to SEQ ID NO: 169
  chr2:63286693-63286748
  hyper

SEQ ID NO: 6194 - DNA, 236 bp, Homo sapiens; identical to SEQ ID NO: 170
  chr2:63287082-63287318
  hyper

SEQ ID NO: 6195 - DNA, 163 bp, Homo sapiens
  chr2:64836470-64836633
  hyper
cggccgctcccccggagccacgcgagccggtcgtggcggctggacccgagcctgggagcctgcaggcggccgcgccgcgctgcgctgccgaaccgcccggagccgcaggtccgccgcccgcccgctcgggggcgccccagcttccggcctccggcggcttccg

SEQ ID NO: 6196 - DNA, 37 bp, Homo sapiens
  chr2:66653429-66653466
  hyper
ctcggaggagatgagcgcaccccggggctcattgctg

SEQ ID NO: 6197 - DNA, 92 bp, Homo sapiens
  chr2:66653842-66653934
  hyper
agtcccccaaacctacgtccctgcgccaaaccaggtgcgagcaaactccgcggaccccgcagctggaagtgcatcctgccgggacccccacc

SEQ ID NO: 6198 - DNA, 176 bp, Homo sapiens
  chr2:66659986-66660162
  hyper
aaggttttgggagaacgtgtgtcagcccttcaggcacacagggtgccagtacggagttgggggcggggaagggtgcagtgcaggcggctgggaaggctcatctgctcggctttatggaaacgctccactgttgggggcaaccaaccccgcgttgactcctgcgaagtgctaaagga

SEQ ID NO: 6199 - DNA, 76 bp, Homo sapiens
  chr2:66660603-66660679
  hyper
ataattgattttccccgcagccaatgcgcggcggcctgggcgggggcgcctcctgattggccgagcactcctccac

SEQ ID NO: 6200 - DNA, 66 bp, Homo sapiens
  chr2:66802875-66802941
  hyper
ttgaagtgagccaggcgggcgagtttcgccccggggaaaagagcccccagccgagcccgggggcaa

SEQ ID NO: 6201 - DNA, 58 bp, Homo sapiens; identical to SEQ ID NO: 171
  chr2:66808576-66808634
  hyper

SEQ ID NO: 6202 - DNA, 665 bp, Homo sapiens; identical to SEQ ID NO: 172
  chr2:66808726-66809391
  hyper

SEQ ID NO: 6203 - DNA, 268 bp, Homo sapiens; identical to SEQ ID NO: 173
  chr2:68546249-68546517
  hyper

SEQ ID NO: 6204 - DNA, 361 bp, Homo sapiens; identical to SEQ ID NO: 174
  chr2:68546552-68546913
  hyper

SEQ ID NO: 6205 - DNA, 67 bp, Homo sapiens
  chr2:68870366-68870433
  hyper
ggtcctttgcaagctcgcggctgagcggggccgtgtccgtccactccgacggcgctgggctgccaag

SEQ ID NO: 6206 - DNA, 121 bp, Homo sapiens
  chr2:68870917-68871038
  hyper
ctcctgatccggccccggaataagaaacccggaccttgcctgccgggctccgcgatgccgcaggtacagagcgcgccctcccggggaggatgctccagggaccccgcgctgcactggctgc

SEQ ID NO: 6207 - DNA, 105 bp, Homo sapiens
  chr2:69240500-69240605
  hyper
ggagttgcgagggagcgagggggaataaaggacccgcgaggaagggcccgcggatggcgcgtccctgagggtcgtggcgagttcgcggagcgtgggaaggagcgg

SEQ ID NO: 6208 - DNA, 64 bp, Homo sapiens
  chr2:69533671-69533735
  hyper
cacgcccacctggggcggtggtccagccgccaggaacccgcttcccagccgctccccctcacgc

SEQ ID NO: 6209 - DNA, 856 bp, Homo sapiens; identical to SEQ ID NO: 1984
  chr2:71503452-71504308
  hyper

SEQ ID NO: 6210 - DNA, 146 bp, Homo sapiens
  chr2:71681047-71681193
  hyper
ccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgc

SEQ ID NO: 6211 - DNA, 30 bp, Homo sapiens
  chr2:71694331-71694361
  hyper
agaggaaataaagtccgagcttttactggg

SEQ ID NO: 6212 - DNA, 127 bp, Homo sapiens
  chr2:72374563-72374690
  hyper
cgggcgccagtggtcccggaaccgcgctgccggcgggctggggaagcccgggctgctgcggcagagaggagggaaggggcggggcggggaccagtgccttcaggctcccggcgccccctggccggcc

SEQ ID NO: 6213 - DNA, 52 bp, Homo sapiens
  chr2:72374713-72374765
  hyper
cgcagctagcggaccccggagtgcagcggagcgagcgcgcccttacctgcag

SEQ ID NO: 6214 - DNA, 58 bp, Homo sapiens
  chr2:73142033-73142091
  hyper
actcctatcacccagcgcattccagcaccccctccccctcccccgggaagtctgcgac

SEQ ID NO: 6215 - DNA, 30 bp, Homo sapiens
  chr2:73143902-73143932
  hyper
gagcctcagagaaggcgagggggtggatct

SEQ ID NO: 6216 - DNA, 139 bp, Homo sapiens
  chr2:73145555-73145694
  hyper
gatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcc

SEQ ID NO: 6217 - DNA, 30 bp, Homo sapiens
  chr2:73146224-73146254
  hyper
gagggcttttaaggtcgtagccagtccgaa

SEQ ID NO: 6218 - DNA, 139 bp, Homo sapiens; identical to SEQ ID NO: 175
  chr2:73147389-73147528
  hyper

SEQ ID NO: 6219 - DNA, 101 bp, Homo sapiens; identical to SEQ ID NO: 176
  chr2:73147966-73148067
  hyper

SEQ ID NO: 6220 - DNA, 19 bp, Homo sapiens
  chr2:73148174-73148193
  hyper
cgtccggccctgagcccct

SEQ ID NO: 6221 - DNA, 616 bp, Homo sapiens; identical to SEQ ID NO: 1988
  chr2:73151215-73151831
  hyper

SEQ ID NO: 6222 - DNA, 53 bp, Homo sapiens
  chr2:73152398-73152451
  hyper
gaaattaacaattaccgtgtagtgtttttgtaactgatcgttaatttaaggga

SEQ ID NO: 6223 - DNA, 15 bp, Homo sapiens
  chr2:73152739-73152754
  hyper
cgaccctactacacc

SEQ ID NO: 6224 - DNA, 36 bp, Homo sapiens
  chr2:73152959-73152995
  hyper
acttaatctacaaatcgctcacgggtcggaggcagg

SEQ ID NO: 6225 - DNA, 43 bp, Homo sapiens
  chr2:73429571-73429614
  hyper
gtgcccaccttgcctcgcacagagcgggcgctcacaggctttg

SEQ ID NO: 6226 - DNA, 23 bp, Homo sapiens
  chr2:73429976-73429999
  hyper
cgcgccggcggcctcccagccgt

SEQ ID NO: 6227 - DNA, 271 bp, Homo sapiens; identical to SEQ ID NO: 178
  chr2:73430485-73430756
  hyper

SEQ ID NO: 6228 - DNA, 32 bp, Homo sapiens
  chr2:73512107-73512139
  hyper
cattcctagggaacccgcggaactgctgctgg

SEQ ID NO: 6229 - DNA, 731 bp, Homo sapiens; identical to SEQ ID NO: 179
  chr2:73518261-73518992
  hyper

SEQ ID NO: 6230 - DNA, 59 bp, Homo sapiens
  chr2:73519211-73519270
  hyper
ctcccctaagtcacccggggccagcgggaaagcgtcataggccccgctgggatagagtc

SEQ ID NO: 6231 - DNA, 252 bp, Homo sapiens; identical to SEQ ID NO: 1991
  chr2:73519523-73519775
  hyper

SEQ ID NO: 6232 - DNA, 151 bp, Homo sapiens
  chr2:73520242-73520393
  hyper
ttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcag

SEQ ID NO: 6233 - DNA, 44 bp, Homo sapiens
  chr2:74726199-74726243
  hyper
aacagagcaacaggtcgctcagttggcgacggtctgcccttttc

SEQ ID NO: 6234 - DNA, 257 bp, Homo sapiens; identical to SEQ ID NO: 1992
  chr2:74740879-74741136
  hyper

SEQ ID NO: 6235 - DNA, 339 bp, Homo sapiens; identical to SEQ ID NO: 1993
  chr2:74741137-74741476
  hyper

SEQ ID NO: 6236 - DNA, 70 bp, Homo sapiens; identical to SEQ ID NO: 1994
  chr2:74741775-74741845
  hyper

SEQ ID NO: 6237 - DNA, 83 bp, Homo sapiens; identical to SEQ ID NO: 1995
  chr2:74741872-74741955
  hyper

SEQ ID NO: 6238 - DNA, 324 bp, Homo sapiens; identical to SEQ ID NO: 180
  chr2:74742324-74742648
  hyper

SEQ ID NO: 6239 - DNA, 452 bp, Homo sapiens; identical to SEQ ID NO: 181
  chr2:74742693-74743145
  hyper

SEQ ID NO: 6240 - DNA, 6 bp, Homo sapiens
  chr2:74743766-74743772
  hyper
cgaagc

SEQ ID NO: 6241 - DNA, 15 bp, Homo sapiens
  chr2:74782073-74782088
  hyper
tgctttgcacactcc

SEQ ID NO: 6242 - DNA, 53 bp, Homo sapiens
  chr2:74782218-74782271
  hyper
cgtcgggacccgggccgcctgcgcacgccactccctctcgagcactctctctc

SEQ ID NO: 6243 - DNA, 67 bp, Homo sapiens
  chr2:75426808-75426875
  hyper
ctgcttgctacttgccgtgggagtctgcgagccgggagccccacgcactccgcgagggggcagtagg

SEQ ID NO: 6244 - DNA, 229 bp, Homo sapiens
  chr2:75427814-75428043
  hyper
ctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaa

SEQ ID NO: 6245 - DNA, 264 bp, Homo sapiens
  chr2:75787807-75788071
  hyper
ttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggagg

SEQ ID NO: 6246 - DNA, 136 bp, Homo sapiens
  chr2:79740169-79740305
  hyper
ggcgggcagagcaggcggcaccgcacctcggccagaggcggctgcagcagctgctgcccttgtccctgccgccgcctctccagtcccttctgtgattaccactccagctgctgggaacgggcgagaaagaggagga

SEQ ID NO: 6247 - DNA, 270 bp, Homo sapiens; identical to SEQ ID NO: 1999
  chr2:80529985-80530255
  hyper

SEQ ID NO: 6248 - DNA, 66 bp, Homo sapiens; identical to SEQ ID NO: 2000
  chr2:80530256-80530322
  hyper

SEQ ID NO: 6249 - DNA, 15 bp, Homo sapiens
  chr2:80530572-80530587
  hyper
ctggttggaactcag

SEQ ID NO: 6250 - DNA, 39 bp, Homo sapiens
  chr2:80531574-80531613
  hyper
aaaaaactccaaactcggggctcgcgactccccaggatc

SEQ ID NO: 6251 - DNA, 192 bp, Homo sapiens
  chr2:80531821-80532013
  hyper
ccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 6252 - DNA, 148 bp, Homo sapiens
  chr2:80549571-80549719
  hyper
cacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgc

SEQ ID NO: 6253 - DNA, 52 bp, Homo sapiens; identical to SEQ ID NO: 2001
  chr2:85107454-85107506
  hyper

SEQ ID NO: 6254 - DNA, 15 bp, Homo sapiens
  chr2:85361295-85361310
  hyper
cgcacccttgccctc

SEQ ID NO: 6255 - DNA, 63 bp, Homo sapiens
  chr2:85361466-85361529
  hyper
cgttctttaaaggacccccgtaccctgggtaccccttcctgatgatcccggacctgagcagcc

SEQ ID NO: 6256 - DNA, 187 bp, Homo sapiens; identical to SEQ ID NO: 2002
  chr2:87016593-87016780
  hyper

SEQ ID NO: 6257 - DNA, 451 bp, Homo sapiens; identical to SEQ ID NO: 2003
  chr2:87017729-87018180
  hyper

SEQ ID NO: 6258 - DNA, 302 bp, Homo sapiens
  chr2:87088727-87089029
  hyper
agtccaggggctctccggtcccccggggtaatgcgatatgggggtattttatttccacccttagggaccgtgcctgccaagctgcctcccgggcgccccgccaccgcgggctcgacgctgcaccctgccaggaccagggccaggacagccacttatcacctccccgctcaggccccgggagcgcagacccttgggtagcccgcgcgccgccgccttacctgtcagctgcgcggccaagaggagccacagccgcggccgcatcgtggcgcgcccgggacacctggccccgggggctcggcgga

SEQ ID NO: 6259 - DNA, 139 bp, Homo sapiens; identical to SEQ ID NO: 2004
  chr2:88751281-88751420
  hyper

SEQ ID NO: 6260 - DNA, 356 bp, Homo sapiens; identical to SEQ ID NO: 2005
  chr2:88751460-88751816
  hyper

SEQ ID NO: 6261 - DNA, 498 bp, Homo sapiens; identical to SEQ ID NO: 2006
  chr2:88751942-88752440
  hyper

SEQ ID NO: 6262 - DNA, 69 bp, Homo sapiens; identical to SEQ ID NO: 183
  chr2:88752716-88752785
  hyper

SEQ ID NO: 6263 - DNA, 171 bp, Homo sapiens; identical to SEQ ID NO: 184
  chr2:89064805-89064976
  hyper

SEQ ID NO: 6264 - DNA, 350 bp, Homo sapiens; identical to SEQ ID NO: 185
  chr2:89065128-89065478
  hyper

SEQ ID NO: 6265 - DNA, 146 bp, Homo sapiens
  chr2:91635198-91635344
  hyper
gccgctttttgcccccgccgccgcgggtttttgcccccgcccccgttgctttttacccccgccgccgcggctttctgcccctgccgacgagggtttttgcggctttatatccccgctgtcatggctttttgcggccgtggcttttt

SEQ ID NO: 6266 - DNA, 30 bp, Homo sapiens
  chr2:95664061-95664091
  hyper
ccttgaaggcacctgcgcagggggacccgc

SEQ ID NO: 6267 - DNA, 30 bp, Homo sapiens
  chr2:95690763-95690793
  hyper
gcatggattcaaggccgacctgccccagca

SEQ ID NO: 6268 - DNA, 474 bp, Homo sapiens; identical to SEQ ID NO: 2010
  chr2:95691026-95691500
  hyper

SEQ ID NO: 6269 - DNA, 218 bp, Homo sapiens; identical to SEQ ID NO: 2011
  chr2:95691501-95691719
  hyper

SEQ ID NO: 6270 - DNA, 290 bp, Homo sapiens
  chr2:95692020-95692310
  hyper
caagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggc

SEQ ID NO: 6271 - DNA, 59 bp, Homo sapiens
  chr2:96012452-96012511
  hyper
tggccgtccgcgctgcgtttcgcgccgccgccgccgccgcgcctcgaagtttgccggct

SEQ ID NO: 6272 - DNA, 44 bp, Homo sapiens
  chr2:96781940-96781984
  hyper
gacgacagcgctgcccggctcggctagacaagagcgtcgcccct

SEQ ID NO: 6273 - DNA, 137 bp, Homo sapiens
  chr2:96782022-96782159
  hyper
cgagcggggcctaggaggtcgggaacacccaggaccagcagccgccctcctacatcctcctccaccggtgcccggggtccctgccgtccgccccagagaagtttcccaagttgtcccgccgccgtccccgtcccgcc

SEQ ID NO: 6274 - DNA, 418 bp, Homo sapiens; identical to SEQ ID NO: 2012
  chr2:96990898-96991316
  hyper

SEQ ID NO: 6275 - DNA, 15 bp, Homo sapiens
  chr2:97193049-97193064
  hyper
cggcagcagagcctg

SEQ ID NO: 6276 - DNA, 386 bp, Homo sapiens; identical to SEQ ID NO: 187
  chr2:97193251-97193637
  hyper

SEQ ID NO: 6277 - DNA, 71 bp, Homo sapiens; identical to SEQ ID NO: 188
  chr2:98963337-98963408
  hyper

SEQ ID NO: 6278 - DNA, 417 bp, Homo sapiens; identical to SEQ ID NO: 189
  chr2:98963409-98963826
  hyper

SEQ ID NO: 6279 - DNA, 325 bp, Homo sapiens; identical to SEQ ID NO: 190
  chr2:98963868-98964193
  hyper

SEQ ID NO: 6280 - DNA, 84 bp, Homo sapiens
  chr2:98964634-98964718
  hyper
cttcctcttcagcctcggttcagccacagagaggggcctcctcctgtgtagatgcccggaggggaggagcggtggttcttgggg

SEQ ID NO: 6281 - DNA, 139 bp, Homo sapiens; identical to SEQ ID NO: 191
  chr2:99439368-99439507
  hyper

SEQ ID NO: 6282 - DNA, 62 bp, Homo sapiens
  chr2:99553419-99553481
  hyper
gctgccttgggtggtcgcccagcgaatctcctccggagcccgagccgcggctttggtctgcg

SEQ ID NO: 6283 - DNA, 136 bp, Homo sapiens
  chr2:100720916-100721052
  hyper
ggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacc

SEQ ID NO: 6284 - DNA, 374 bp, Homo sapiens
  chr2:100937836-100938210
  hyper
caggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctc

SEQ ID NO: 6285 - DNA, 216 bp, Homo sapiens
  chr2:100938329-100938545
  hyper
cggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggct

SEQ ID NO: 6286 - DNA, 225 bp, Homo sapiens
  chr2:100938574-100938799
  hyper
cgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggcc

SEQ ID NO: 6287 - DNA, 10 bp, Homo sapiens
  chr2:100938800-100938810
  hyper
ggacaggcac

SEQ ID NO: 6288 - DNA, 178 bp, Homo sapiens
  chr2:100938984-100939162
  hyper
cgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttc

SEQ ID NO: 6289 - DNA, 170 bp, Homo sapiens
  chr2:101034025-101034195
  hyper
cggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtgggga

SEQ ID NO: 6290 - DNA, 30 bp, Homo sapiens
  chr2:102090404-102090434
  hyper
cgggaagggtgacaacggggaagtcacaga

SEQ ID NO: 6291 - DNA, 53 bp, Homo sapiens
  chr2:102090961-102091014
  hyper
gccccgccgaggatgcgcggaccccgccctgcatcctgcggtgtgggctggag

SEQ ID NO: 6292 - DNA, 178 bp, Homo sapiens; identical to SEQ ID NO: 192
  chr2:105458974-105459152
  hyper

SEQ ID NO: 6293 - DNA, 361 bp, Homo sapiens; identical to SEQ ID NO: 193
  chr2:105459902-105460263
  hyper

SEQ ID NO: 6294 - DNA, 247 bp, Homo sapiens; identical to SEQ ID NO: 194
  chr2:105460264-105460511
  hyper

SEQ ID NO: 6295 - DNA, 30 bp, Homo sapiens
  chr2:105460921-105460951
  hyper
ggagagggtgatacacgttcacacaccgct

SEQ ID NO: 6296 - DNA, 108 bp, Homo sapiens
  chr2:105461166-105461274
  hyper
ccggtgggcagccctcgacccggggcgcgtccacagcgcccacccgcggcccccaaacacctcgagagcagatcttaggggttaaccaggcaccgacctgaggcgccc

SEQ ID NO: 6297 - DNA, 113 bp, Homo sapiens; identical to SEQ ID NO: 2022
  chr2:105461555-105461668
  hyper

SEQ ID NO: 6298 - DNA, 84 bp, Homo sapiens; identical to SEQ ID NO: 2023
  chr2:105461699-105461783
  hyper

SEQ ID NO: 6299 - DNA, 30 bp, Homo sapiens
  chr2:105468569-105468599
  hyper
atacatatacgcatacgtaaatataaaaag

SEQ ID NO: 6300 - DNA, 195 bp, Homo sapiens
  chr2:105468836-105469031
  hyper
gagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgc

SEQ ID NO: 6301 - DNA, 212 bp, Homo sapiens; identical to SEQ ID NO: 2024
  chr2:105469645-105469857
  hyper

SEQ ID NO: 6302 - DNA, 681 bp, Homo sapiens; identical to SEQ ID NO: 2025
  chr2:105469880-105470561
  hyper

SEQ ID NO: 6303 - DNA, 246 bp, Homo sapiens; identical to SEQ ID NO: 2026
  chr2:105470562-105470808
  hyper

SEQ ID NO: 6304 - DNA, 167 bp, Homo sapiens
  chr2:105471573-105471740
  hyper
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgc

SEQ ID NO: 6305 - DNA, 204 bp, Homo sapiens
  chr2:105472057-105472261
  hyper
cggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggt

SEQ ID NO: 6306 - DNA, 756 bp, Homo sapiens
  chr2:105472783-105473539
  hyper
ccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgcc

SEQ ID NO: 6307 - DNA, 215 bp, Homo sapiens
  chr2:105473599-105473814
  hyper
ctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagg

SEQ ID NO: 6308 - DNA, 292 bp, Homo sapiens; identical to SEQ ID NO: 2027
  chr2:105478762-105479054
  hyper

SEQ ID NO: 6309 - DNA, 47 bp, Homo sapiens; identical to SEQ ID NO: 2028
  chr2:105479055-105479102
  hyper

SEQ ID NO: 6310 - DNA, 951 bp, Homo sapiens
  chr2:105488281-105489232
  hyper
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacctgccagaccttcccacgcgcgggccgcctgggttctggggctttcgtgacgtcttccctcatcgcgctccccacccccgaacacacacacacagacacacacacacacacactcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaa

SEQ ID NO: 6311 - DNA, 139 bp, Homo sapiens
  chr2:105760945-105761084
  hyper
gaggccacgcggggacggaggaggcagagaggacgggctgtgatggagaaacgggagaggagccggccaggcgccaccgtcaccaccatcaccaaccaccaccaccatcaccatcactgactgtcgcccatcccagctc

SEQ ID NO: 6312 - DNA, 95 bp, Homo sapiens
  chr2:106014945-106015040
  hyper
acagcgtcacctccccgcagccgccggctgggacccgcggccagcctttacccaggctcgcccggtccctgcccgcatggcggtgccccacctgg

SEQ ID NO: 6313 - DNA, 212 bp, Homo sapiens
  chr2:107103854-107104066
  hyper
cggggccaggtgtcccgggcgcgccccgatgcggccgcggctgtggctcctcctggccgcgcagctgacaggtaaggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttgg

SEQ ID NO: 6314 - DNA, 111 bp, Homo sapiens; identical to SEQ ID NO: 2029
  chr2:107502619-107502730
  hyper

SEQ ID NO: 6315 - DNA, 43 bp, Homo sapiens; identical to SEQ ID NO: 2030
  chr2:107502865-107502908
  hyper

SEQ ID NO: 6316 - DNA, 222 bp, Homo sapiens
  chr2:107503670-107503892
  hyper
gcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaacccca

SEQ ID NO: 6317 - DNA, 73 bp, Homo sapiens
  chr2:108603211-108603284
  hyper
cactccaggtaggagcggagcgggcattcctgcgcctacgggcccgcaccctcggaaacgccttgggcaccga

SEQ ID NO: 6318 - DNA, 154 bp, Homo sapiens
  chr2:109648119-109648273
  hyper
agagcgccgcttcagcgtcggccacgtgggccgggctctgccggtggcaacctggacgcgctgcgggcgccggcgagacctgcgccaacgcctacctccgggccacaggcgggataaagctgccccactttgcccccagcgaagagaaccctcc

SEQ ID NO: 6319 - DNA, 30 bp, Homo sapiens
  chr2:109744973-109745003
  hyper
ccccttcaactggagcgccttcccctcctg

SEQ ID NO: 6320 - DNA, 45 bp, Homo sapiens
  chr2:109745234-109745279
  hyper
aggctcacgaaaagccgaaaaagactcggacgcttggaggaggca

SEQ ID NO: 6321 - DNA, 300 bp, Homo sapiens
  chr2:109745500-109745800
  hyper
cgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgc

SEQ ID NO: 6322 - DNA, 61 bp, Homo sapiens
  chr2:109746018-109746079
  hyper
tgtgcgcatccaaggcggccgccgctgctgcgcagagcgagggcgacgaggacaggccagg

SEQ ID NO: 6323 - DNA, 99 bp, Homo sapiens
  chr2:109746289-109746388
  hyper
catcctggtgggctgcggcgtggacgaactgcccgccaacatcttgctggtgcgactgctggacggcatccgtcagcggccccgcgcgggcaccagccc

SEQ ID NO: 6324 - DNA, 96 bp, Homo sapiens
  chr2:111490570-111490666
  hyper
ggtgccctctcctcccgagctccctcccccacgaagagtcgggtgcagggctgggccccgcggtgacaggcgcggtgtctacgaagaccgtgtggc

SEQ ID NO: 6325 - DNA, 30 bp, Homo sapiens
  chr2:111875387-111875417
  hyper
ctctaacgggtgtggcgggaagtgtggtgg

SEQ ID NO: 6326 - DNA, 77 bp, Homo sapiens
  chr2:112656725-112656802
  hyper
gtctggtctgggatgcgacgagaactttccactagagttgcatggtggggccccgctctggccggagtcccgggggc

SEQ ID NO: 6327 - DNA, 53 bp, Homo sapiens
  chr2:112657039-112657092
  hyper
tacagtgctcggcagcgtttacgtttatctggattcagcgaagtgttgttaca

SEQ ID NO: 6328 - DNA, 234 bp, Homo sapiens; identical to SEQ ID NO: 2031
  chr2:114256954-114257188
  hyper

SEQ ID NO: 6329 - DNA, 54 bp, Homo sapiens
  chr2:114260999-114261053
  hyper
tcctcccggcctctgcgccaccgcccccggtgcaggacgcgctttgctctcgcc

SEQ ID NO: 6330 - DNA, 184 bp, Homo sapiens; identical to SEQ ID NO: 2032
  chr2:114261280-114261464
  hyper

SEQ ID NO: 6331 - DNA, 37 bp, Homo sapiens
  chr2:115918847-115918884
  hyper
ggggctccgggaccccggtccccgggctgccccctgc

SEQ ID NO: 6332 - DNA, 88 bp, Homo sapiens
  chr2:115919337-115919425
  hyper
cgagggagggaccctacgacggggagcccgcccggtgccgctcttcttcccctccccgcccctccgctccccccaccccgtcccttcc

SEQ ID NO: 6333 - DNA, 44 bp, Homo sapiens
  chr2:115920177-115920221
  hyper
acggagcttggggagcggcgaggcattaacgattaagtggagcc

SEQ ID NO: 6334 - DNA, 113 bp, Homo sapiens
  chr2:115920421-115920534
  hyper
gggtgattgggacttcggtgtcgctctttttccaaagttggagggtcgggagcgccgagacaccctggcgaggaggaggaggaggaggagggaggctgcgctgagccgggtgc

SEQ ID NO: 6335 - DNA, 683 bp, Homo sapiens; identical to SEQ ID NO: 195
  chr2:118981174-118981857
  hyper

SEQ ID NO: 6336 - DNA, 203 bp, Homo sapiens; identical to SEQ ID NO: 196
  chr2:118981945-118982148
  hyper

SEQ ID NO: 6337 - DNA, 244 bp, Homo sapiens; identical to SEQ ID NO: 197
  chr2:118982253-118982497
  hyper

SEQ ID NO: 6338 - DNA, 402 bp, Homo sapiens; identical to SEQ ID NO: 2036
  chr2:119067695-119068097
  hyper

SEQ ID NO: 6339 - DNA, 101 bp, Homo sapiens
  chr2:119532154-119532255
  hyper
ccgggaggtggaaggcggagagcggcgagggctccggctccggacccagccgagcgcgcagcgtgaagcggagaacgccgggttagcgccaggctgaatcc

SEQ ID NO: 6340 - DNA, 30 bp, Homo sapiens
  chr2:119591351-119591381
  hyper
ggtccctaccccacccggggtagcgggagg

SEQ ID NO: 6341 - DNA, 141 bp, Homo sapiens; identical to SEQ ID NO: 2037
  chr2:119592997-119593138
  hyper

SEQ ID NO: 6342 - DNA, 93 bp, Homo sapiens
  chr2:119593865-119593958
  hyper
aaactgctgattgtgcggggataggggcatcttaatctgggaaaagatcggaatctcttgggacgctaatctgagacccgggtcggaggtgta

SEQ ID NO: 6343 - DNA, 53 bp, Homo sapiens
  chr2:119599978-119600031
  hyper
cagagaaaccagggccggcgatgcgggtcgggaggcaccggagaagcaatgac

SEQ ID NO: 6344 - DNA, 367 bp, Homo sapiens
  chr2:119600471-119600838
  hyper
ggtgccgggagggggcgcgggcgcggccccggcctgtggcggctactcgctctcgtctttgtcctggaccgtggtggtggagtggttgtacagtccctgggccatgaggtgcagcgccaggccgttcttgatgcctgtggctttcttgatcttggcgcgcttgttctggaaccagatcttgatctgggactcgttgaggctgagttcctgggccagggtctgccgccgctgctccgtgatgtagcggtttgcctggaactccgccttgagtctctgcagctgctcggccgtgaacgcggtccgcggccgcttgtcctccttctcgttcttcttcttcttcagcttcctggtgcgcggacctgcagcg

SEQ ID NO: 6345 - DNA, 29 bp, Homo sapiens
  chr2:119602601-119602630
  hyper
ctcttgtaataaaatcgttcctagtctcc

SEQ ID NO: 6346 - DNA, 81 bp, Homo sapiens; identical to SEQ ID NO: 2038
  chr2:119603030-119603111
  hyper

SEQ ID NO: 6347 - DNA, 159 bp, Homo sapiens
  chr2:119604037-119604196
  hyper
cggggctccccgcgccgcctccactgccgccgccaccggtgtccgagggcttggctgctgcggccgccgccgccgccgccactgccgccgcggccgccgccgccgccgcagccgggttcccagctttagacgcgcccgcgccggcggcggctggctggg

SEQ ID NO: 6348 - DNA, 254 bp, Homo sapiens
  chr2:119604426-119604680
  hyper
aaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 6349 - DNA, 162 bp, Homo sapiens
  chr2:119604689-119604851
  hyper
cgcgccgagggccgagtcgcgctgacttttaggttccggctgctgttcttccatgctcggccgccccgccgccccggccgccgcgccggcccccgcccccaccgcctcgctccccaccccactttgccagcggcccgtgggggtgcgcggaggaaggaggca

SEQ ID NO: 6350 - DNA, 30 bp, Homo sapiens
  chr2:119606783-119606813
  hyper
atcttagagctccagcggacctcctcgccc

SEQ ID NO: 6351 - DNA, 182 bp, Homo sapiens; identical to SEQ ID NO: 2039
  chr2:119607442-119607624
  hyper

SEQ ID NO: 6352 - DNA, 7 bp, Homo sapiens
  chr2:119607847-119607854
  hyper
cgtcccc

SEQ ID NO: 6353 - DNA, 71 bp, Homo sapiens
  chr2:119610540-119610611
  hyper
cgctgggactgtatcacacagccagacaggcctctggagctgagaattttagacttcgctgctccgggaag

SEQ ID NO: 6354 - DNA, 44 bp, Homo sapiens
  chr2:119611687-119611731
  hyper
aagctgggaggggaacgagtgtgtagccccgcgcgtgcgtgttt

SEQ ID NO: 6355 - DNA, 30 bp, Homo sapiens
  chr2:119613184-119613214
  hyper
cttaaacagtggaaccgtgaggccgctcta

SEQ ID NO: 6356 - DNA, 949 bp, Homo sapiens
  chr2:119614622-119615571
  hyper
ctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagacc

SEQ ID NO: 6357 - DNA, 142 bp, Homo sapiens; identical to SEQ ID NO: 198
  chr2:119616141-119616283
  hyper

SEQ ID NO: 6358 - DNA, 35 bp, Homo sapiens
  chr2:119616517-119616552
  hyper
gacatctcagggtcccgggcctccaagctcatggc

SEQ ID NO: 6359 - DNA, 150 bp, Homo sapiens
  chr2:119769161-119769311
  hyper
ttgctttctctctcccggcacgcggggtcgctgcaggccgtgctcagccctccaggagccggccggtgtccgcgctcgcgggcggctctgggaccgggagaggctgcggctccccgctaaggctcctgcggccggcgcctcctggaccca

SEQ ID NO: 6360 - DNA, 202 bp, Homo sapiens
  chr2:119914553-119914755
  hyper
ggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaa

SEQ ID NO: 6361 - DNA, 440 bp, Homo sapiens
  chr2:119915167-119915607
  hyper
gttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggt

SEQ ID NO: 6362 - DNA, 2 bp, Homo sapiens
  chr2:119916524-119916526
  hyper
cg

SEQ ID NO: 6363 - DNA, 39 bp, Homo sapiens
  chr2:120190272-120190311
  hyper
aggattagagaggcccgttgacttcgtgtacaaacgctc

SEQ ID NO: 6364 - DNA, 178 bp, Homo sapiens
  chr2:121104414-121104592
  hyper
gctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggctta

SEQ ID NO: 6365 - DNA, 155 bp, Homo sapiens
  chr2:121104793-121104948
  hyper
tgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagg

SEQ ID NO: 6366 - DNA, 75 bp, Homo sapiens
  chr2:121344942-121345017
  hyper
gccgctttgtgcccgcggccggcggaggtgggggccgcgcgtccccggatccccctgccccggcccggcccgcgg

SEQ ID NO: 6367 - DNA, 40 bp, Homo sapiens
  chr2:121493902-121493942
  hyper
aagcgcctcccacctcggccaagcgcgggccgactgggat

SEQ ID NO: 6368 - DNA, 73 bp, Homo sapiens
  chr2:124782333-124782406
  hyper
ctgcaagcaggggagcgcgcacaacgttaaaccttgaaaccagaaatcccgatcctatcgagacccatcagct

SEQ ID NO: 6369 - DNA, 481 bp, Homo sapiens; identical to SEQ ID NO: 2043
  chr2:124782692-124783173
  hyper

SEQ ID NO: 6370 - DNA, 30 bp, Homo sapiens
  chr2:124783375-124783405
  hyper
ctatctaagcgtactcgattgtgtctgctt

SEQ ID NO: 6371 - DNA, 125 bp, Homo sapiens; identical to SEQ ID NO: 2044
  chr2:127783043-127783168
  hyper

SEQ ID NO: 6372 - DNA, 412 bp, Homo sapiens; identical to SEQ ID NO: 2045
  chr2:127783169-127783581
  hyper

SEQ ID NO: 6373 - DNA, 30 bp, Homo sapiens
  chr2:127863640-127863670
  hyper
tccgcgaggaggggtcgggtttcctgtggc

SEQ ID NO: 6374 - DNA, 366 bp, Homo sapiens
  chr2:127976392-127976758
  hyper
gctgggccgggcacccggggaggcggacgatgggcgaaggcatcggagggcgccgccgcggctcgggtgcagtgcccctgccacgaagggcgcaacggaggtgggcgtgggaaggacagcactcaggctccaagtgggaagcgtgcggaattcgccggccccaacgccctagcgggtggctgggacccctgggttcctcccacgtccctgcctccagtcccggcgcgaactccaggtgtcgcccccaactccggcttagagcctacggcaccccgagcctccgagcctccgtcccctcttcccccgccattacaaaatacaaaaaggactagaaatgaatacacacggtctcggccacctaaggac

SEQ ID NO: 6375 - DNA, 28 bp, Homo sapiens
  chr2:128421822-128421850
  hyper
gccgccgcagctttccggccattgtccc

SEQ ID NO: 6376 - DNA, 57 bp, Homo sapiens
  chr2:128421890-128421947
  hyper
cggcgggctctgccggtgctggcgccgccggtacagccccgacgcggccagcgcacc

SEQ ID NO: 6377 - DNA, 91 bp, Homo sapiens
  chr2:128433386-128433477
  hyper
cagggaggctaaagccgagaggcgtccctcttcagtcgcaaagctgctttccccgggaaattccgatttcatcccccgttgcgggccatcg

SEQ ID NO: 6378 - DNA, 15 bp, Homo sapiens
  chr2:130737190-130737205
  hyper
aaaactgtgttgagg

SEQ ID NO: 6379 - DNA, 162 bp, Homo sapiens; identical to SEQ ID NO: 2046
  chr2:130737475-130737637
  hyper

SEQ ID NO: 6380 - DNA, 91 bp, Homo sapiens
  chr2:130763551-130763642
  hyper
cctccgccaggcctgcgctgcctcgccccgggagaggaagactgagcccggctcaggcggctggagcgcgcgggcccgtttcctttcagcg

SEQ ID NO: 6381 - DNA, 30 bp, Homo sapiens
  chr2:130971230-130971260
  hyper
gcggcgggcccggggcgctgccgccgcggc

SEQ ID NO: 6382 - DNA, 198 bp, Homo sapiens
  chr2:131484889-131485087
  hyper
cagcagagagaggctcggccttggccctcagccctgcagcacacagggcacccgcgcagagagcgtggcctgcgaatggctctgctgcctctcccggcctggggccgattagaccggtcagagcatctgtaaagtacaaggggcccctagggagtgcaggccagggcagctggggcagggaggcggggtccgccccat

SEQ ID NO: 6383 - DNA, 89 bp, Homo sapiens
  chr2:131485343-131485432
  hyper
tggtgggcgtggccccgggctgcggcgggcgtggtccccgggctgcggcggacgtggtcaggggcggttctgggcgtggtccctgggct

SEQ ID NO: 6384 - DNA, 301 bp, Homo sapiens
  chr2:131513559-131513860
  hyper
aggcgcagccgcaaccgggtgggaggcagagacacccagaaacagagacggggcgatacgaacagacaaagccggctcgagcgcggcccgagcggcggcgcagggaggcggcagcctggcggagcagcccccaccgcggccggcgcgccccctcgccacccctgcgcgccagcgccggcccgcccctcccgctggcctctggcggcttaaccctcgcctgcccgaccccgcggggcccctggagccgcggtgggtgggtgcgggcgccgggcctccccctcccggccgcggcgcgcggcgc

SEQ ID NO: 6385 - DNA, 54 bp, Homo sapiens
  chr2:131595112-131595166
  hyper
gccccctctctggcccgatttccgggcccgctcaccatccgggacccactcagt

SEQ ID NO: 6386 - DNA, 272 bp, Homo sapiens; identical to SEQ ID NO: 2047
  chr2:131720827-131721099
  hyper

SEQ ID NO: 6387 - DNA, 124 bp, Homo sapiens; identical to SEQ ID NO: 2048
  chr2:131721461-131721585
  hyper

SEQ ID NO: 6388 - DNA, 83 bp, Homo sapiens; identical to SEQ ID NO: 2049
  chr2:131721866-131721949
  hyper

SEQ ID NO: 6389 - DNA, 295 bp, Homo sapiens; identical to SEQ ID NO: 2050
  chr2:131792225-131792520
  hyper

SEQ ID NO: 6390 - DNA, 106 bp, Homo sapiens; identical to SEQ ID NO: 2051
  chr2:131792531-131792637
  hyper

SEQ ID NO: 6391 - DNA, 30 bp, Homo sapiens
  chr2:131792996-131793026
  hyper
aggggcgtggtggcacgtgtgtcacagggt

SEQ ID NO: 6392 - DNA, 35 bp, Homo sapiens
  chr2:132088604-132088639
  hyper
gcgctccctgaaatccgggctgtccaagtaggaat

SEQ ID NO: 6393 - DNA, 187 bp, Homo sapiens
  chr2:132121342-132121529
  hyper
cgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaa

SEQ ID NO: 6394 - DNA, 184 bp, Homo sapiens; identical to SEQ ID NO: 2052
  chr2:132152311-132152495
  hyper

SEQ ID NO: 6395 - DNA, 325 bp, Homo sapiens; identical to SEQ ID NO: 199
  chr2:132182764-132183089
  hyper

SEQ ID NO: 6396 - DNA, 81 bp, Homo sapiens
  chr2:132767414-132767495
  hyper
aaccccacaaaaacccgcggcgacggggggaaaaaaccgcggcggcaaaaagcctcagcggcaggagcaaaaagccgccgc

SEQ ID NO: 6397 - DNA, 140 bp, Homo sapiens
  chr2:132767735-132767875
  hyper
gcaaaaagctgccgcagcggtgacgaaaagccacaggggcgggggcaaaaagccgcaaaaagccccgacggcgggtcaaagagccgcaaaaagccccagcgtcgggggcaaaaagccgcggctgccggggcaaaaagcag

SEQ ID NO: 6398 - DNA, 79 bp, Homo sapiens
  chr2:132796105-132796184
  hyper
acgggggtaaaaagccgcggcgacaaaaagccgctgagagggggcaaaaagcagcgggagcgggggcaaaacacaaaaa

SEQ ID NO: 6399 - DNA, 104 bp, Homo sapiens
  chr2:133015320-133015424
  hyper
ggagggggcctgcggtaccaggaaaaatctgcgtgcggcaaccttgagccttcgcggtctgggcagggggcctggccgctgcgcgtgcgcgcaatccccgaagg

SEQ ID NO: 6400 - DNA, 30 bp, Homo sapiens
  chr2:133015649-133015679
  hyper
cgcgtctcactcaaccgcctcgacccccac

SEQ ID NO: 6401 - DNA, 56 bp, Homo sapiens
  chr2:133426223-133426279
  hyper
ccactcctgggtctccgggtagggctggatgtggctgacaccggcagggggcggcg

SEQ ID NO: 6402 - DNA, 79 bp, Homo sapiens
  chr2:133427558-133427637
  hyper
cagcggaggctgccccggctgcagcggctgtggctgccgaggctgctggggcccgcgctgctgccgcggagacgacggt

SEQ ID NO: 6403 - DNA, 321 bp, Homo sapiens
  chr2:135475874-135476195
  hyper
ggcagccggcggagccgcaggggactacggaaaggaggatgcaacgagcctgggtccctccgagctgagtagggcccggagtggcccagaagcgctcgactccgaacgcaaaaaatgcctcccgcaaacttttcccgtgggcgccggagggcctggagctggcggagaggagggcgcgagtccaggcggggtcggcctgaaggcagctggggtctgggcttcgagggaaggaaccgcagccgaggcggtgccggccgcagaaggtggggctgccgctctcggctagcggcgttctcgccgggaagtcggggctccgcgccc

SEQ ID NO: 6404 - DNA, 49 bp, Homo sapiens
  chr2:135476941-135476990
  hyper
gattcctctggggtccgcgaagcccgcggccgcgcgtgggtagcagaca

SEQ ID NO: 6405 - DNA, 75 bp, Homo sapiens
  chr2:136876531-136876606
  hyper
gagatgcatttagtccgatatttatagaaggacgaactgcgtgccacgcactgttctaggcgttggggatccagc

SEQ ID NO: 6406 - DNA, 41 bp, Homo sapiens
  chr2:137522445-137522486
  hyper
ttctcctagtaacaccgaagccctctcgtgcccggggactg

SEQ ID NO: 6407 - DNA, 32 bp, Homo sapiens
  chr2:137522850-137522882
  hyper
agggtcgtgcgggtgcgcggcagaggcggtag

SEQ ID NO: 6408 - DNA, 30 bp, Homo sapiens
  chr2:137523564-137523594
  hyper
ccgaaccttgggacccgggcagcaggagct

SEQ ID NO: 6409 - DNA, 371 bp, Homo sapiens; identical to SEQ ID NO: 200
  chr2:139536937-139537308
  hyper

SEQ ID NO: 6410 - DNA, 50 bp, Homo sapiens
  chr2:139537771-139537821
  hyper
agccagggaccaccacgaggggcagcggccgcaggcgcatggtgccggct

SEQ ID NO: 6411 - DNA, 149 bp, Homo sapiens
  chr2:142888097-142888246
  hyper
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctgg

SEQ ID NO: 6412 - DNA, 34 bp, Homo sapiens
  chr2:142888484-142888518
  hyper
gaaggtggagggatgcgcgcgtgcgggagagagg

SEQ ID NO: 6413 - DNA, 200 bp, Homo sapiens; identical to SEQ ID NO: 2055
  chr2:144694315-144694515
  hyper

SEQ ID NO: 6414 - DNA, 704 bp, Homo sapiens; identical to SEQ ID NO: 2056
  chr2:144694553-144695257
  hyper

SEQ ID NO: 6415 - DNA, 31 bp, Homo sapiens; identical to SEQ ID NO: 2057
  chr2:144695258-144695289
  hyper

SEQ ID NO: 6416 - DNA, 463 bp, Homo sapiens; identical to SEQ ID NO: 201
  chr2:145273327-145273790
  hyper

SEQ ID NO: 6417 - DNA, 431 bp, Homo sapiens; identical to SEQ ID NO: 2059
  chr2:145274080-145274511
  hyper

SEQ ID NO: 6418 - DNA, 399 bp, Homo sapiens; identical to SEQ ID NO: 2060
  chr2:145274576-145274975
  hyper

SEQ ID NO: 6419 - DNA, 479 bp, Homo sapiens; identical to SEQ ID NO: 2061
  chr2:145274976-145275455
  hyper

SEQ ID NO: 6420 - DNA, 132 bp, Homo sapiens
  chr2:145277493-145277625
  hyper
aaaaaaacctacctgcgaagtcttgtttgtagttttggccagaaatggtgagaagaaaaagcatgaagaagccgcgaagtgtgggggagaaaaaggtggaagcgaagaaacagctcccggagcaaactgtac

SEQ ID NO: 6421 - DNA, 92 bp, Homo sapiens; identical to SEQ ID NO: 2062
  chr2:145281307-145281399
  hyper

SEQ ID NO: 6422 - DNA, 188 bp, Homo sapiens
  chr2:145281754-145281942
  hyper
cccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgccc

SEQ ID NO: 6423 - DNA, 36 bp, Homo sapiens
  chr2:145281943-145281979
  hyper
gtcagctgacctggctcgctcgcctgctccccgccc

SEQ ID NO: 6424 - DNA, 78 bp, Homo sapiens
  chr2:145282041-145282119
  hyper
gggaggtgatgccgggggctgattaccatgagaaaggctgtgcctggaaaagcctcctccacgcgactgtcaatctca

SEQ ID NO: 6425 - DNA, 746 bp, Homo sapiens; identical to SEQ ID NO: 2063
  chr2:149633311-149634057
  hyper

SEQ ID NO: 6426 - DNA, 24 bp, Homo sapiens
  chr2:149645535-149645559
  hyper
ccgcagcaagggctgcgaccccgc

SEQ ID NO: 6427 - DNA, 287 bp, Homo sapiens; identical to SEQ ID NO: 203
  chr2:149645560-149645847
  hyper

SEQ ID NO: 6428 - DNA, 198 bp, Homo sapiens
  chr2:152954698-152954896
  hyper
agcccgagcaccggccgaggccgggaagagacgcgcgcgggcttgacccgcagctcccgcacgtgtgggccacggccggctccaggacccccgcgccgcgcgctcggcctcctccccatcctggtctcccgcctccttctcatacctgtctgaggatgaagctggtcgaagtggtgctgccatcggatcttttcaacc

SEQ ID NO: 6429 - DNA, 357 bp, Homo sapiens
  chr2:154333374-154333731
  hyper
aattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 6430 - DNA, 247 bp, Homo sapiens; identical to SEQ ID NO: 2066
  chr2:154334199-154334446
  hyper

SEQ ID NO: 6431 - DNA, 266 bp, Homo sapiens; identical to SEQ ID NO: 2067
  chr2:154335184-154335450
  hyper

SEQ ID NO: 6432 - DNA, 158 bp, Homo sapiens
  chr2:154729082-154729240
  hyper
gcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcagg

SEQ ID NO: 6433 - DNA, 30 bp, Homo sapiens
  chr2:154729766-154729796
  hyper
gacctgaaggaggggcgcaaggggttagag

SEQ ID NO: 6434 - DNA, 47 bp, Homo sapiens
  chr2:157176592-157176639
  hyper
gacctccacgaggtgcggacgcgcctctgccccgcccttttgtgcgc

SEQ ID NO: 6435 - DNA, 1265 bp, Homo sapiens; identical to SEQ ID NO: 204
  chr2:157176900-157178165
  hyper

SEQ ID NO: 6436 - DNA, 13 bp, Homo sapiens
  chr2:157178166-157178179
  hyper
aggcccaggcagg

SEQ ID NO: 6437 - DNA, 30 bp, Homo sapiens
  chr2:160760685-160760715
  hyper
aaggtgaccaagggccgaaggaaaagcgag

SEQ ID NO: 6438 - DNA, 64 bp, Homo sapiens
  chr2:160761069-160761133
  hyper
ggactgcggggctggcgtgcccgcggttacctgcgcggccagagggctccgcgagatcgaagaa

SEQ ID NO: 6439 - DNA, 43 bp, Homo sapiens
  chr2:162095596-162095639
  hyper
cgcgcgcccactccccggggcggtggggcgaggacccgcgctc

SEQ ID NO: 6440 - DNA, 441 bp, Homo sapiens
  chr2:162273508-162273949
  hyper
gccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctct

SEQ ID NO: 6441 - DNA, 30 bp, Homo sapiens
  chr2:162274914-162274944
  hyper
atggaactggatacacgtttctttgcttca

SEQ ID NO: 6442 - DNA, 55 bp, Homo sapiens; identical to SEQ ID NO: 206
  chr2:162275172-162275227
  hyper

SEQ ID NO: 6443 - DNA, 128 bp, Homo sapiens; identical to SEQ ID NO: 207
  chr2:162275310-162275438
  hyper

SEQ ID NO: 6444 - DNA, 128 bp, Homo sapiens; identical to SEQ ID NO: 208
  chr2:162275472-162275600
  hyper

SEQ ID NO: 6445 - DNA, 264 bp, Homo sapiens; identical to SEQ ID NO: 209
  chr2:162280152-162280416
  hyper

SEQ ID NO: 6446 - DNA, 216 bp, Homo sapiens; identical to SEQ ID NO: 210
  chr2:162280740-162280956
  hyper

SEQ ID NO: 6447 - DNA, 238 bp, Homo sapiens; identical to SEQ ID NO: 211
  chr2:162283365-162283603
  hyper

SEQ ID NO: 6448 - DNA, 273 bp, Homo sapiens; identical to SEQ ID NO: 212
  chr2:162283782-162284055
  hyper

SEQ ID NO: 6449 - DNA, 38 bp, Homo sapiens
  chr2:162284338-162284376
  hyper
gacgaaagaagaagacgagcgtgcggctagcactgtat

SEQ ID NO: 6450 - DNA, 34 bp, Homo sapiens
  chr2:162930251-162930285
  hyper
ctgtgagtggctctccgggacattcaaagctcga

SEQ ID NO: 6451 - DNA, 52 bp, Homo sapiens
  chr2:162930338-162930390
  hyper
cgtcccttcacctgtcagagggtggccttggggcttccgcctaaggggagtc

SEQ ID NO: 6452 - DNA, 25 bp, Homo sapiens
  chr2:163695246-163695271
  hyper
cggactgccgcgggtgagagggttt

SEQ ID NO: 6453 - DNA, 30 bp, Homo sapiens
  chr2:163695477-163695507
  hyper
atggaagacttgtgccggttttgctggaag

SEQ ID NO: 6454 - DNA, 141 bp, Homo sapiens
  chr2:164592629-164592770
  hyper
agagggagaaagagacggaggctgccgtgagggagagaagacgggaggcagtggcgagaggcgggcagtggagagagacgggcagcgggaggaccaggagggagagggagaggcgcacggagcccgcggagctggaggggg

SEQ ID NO: 6455 - DNA, 30 bp, Homo sapiens
  chr2:164593340-164593370
  hyper
ccagttcccctcccccgcctccctgtgaat

SEQ ID NO: 6456 - DNA, 31 bp, Homo sapiens
  chr2:167233063-167233094
  hyper
cggtgacgctcaagaccggtatctaggctat

SEQ ID NO: 6457 - DNA, 203 bp, Homo sapiens
  chr2:168150033-168150236
  hyper
cacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaa

SEQ ID NO: 6458 - DNA, 228 bp, Homo sapiens; identical to SEQ ID NO: 2077
  chr2:168150566-168150794
  hyper

SEQ ID NO: 6459 - DNA, 42 bp, Homo sapiens
  chr2:170218695-170218737
  hyper
accgggagcagctcccgcgccgccgcccggccctagcccctg

SEQ ID NO: 6460 - DNA, 175 bp, Homo sapiens
  chr2:170219365-170219540
  hyper
acagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcac

SEQ ID NO: 6461 - DNA, 51 bp, Homo sapiens
  chr2:170219958-170220009
  hyper
aaaattgaaaaagagcgaacgtcttctccatggttccggtacccttttata

SEQ ID NO: 6462 - DNA, 358 bp, Homo sapiens
  chr2:171568345-171568703
  hyper
gcgcaagtgtcactgcgggttcacctaccggcctcttcctctcgcaggtggcatgcagtcggcgctcgccgcccgcccgcaaagaaacggcaatgcaaacttcccagcctgggaaccccgctgcttggagagcagctccgctgtgccagccgccgccaggagactggtattcaacctccccgccccccgccacggttaaagtttgctccacattcgcagctcccaccccacccccatctccgccccgaggcaggaggaccacataggagttcctgggtccaccgtgcgcaaacacacccaccaacaaaagaaagcccattaaatcttccctcctgtgaactcgcgccccaacggatac

SEQ ID NO: 6463 - DNA, 431 bp, Homo sapiens
  chr2:171570470-171570901
  hyper
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtg

SEQ ID NO: 6464 - DNA, 35 bp, Homo sapiens
  chr2:171669891-171669926
  hyper
gcttcccccagttctcgtctcgggagacagacgtt

SEQ ID NO: 6465 - DNA, 205 bp, Homo sapiens
  chr2:171670242-171670447
  hyper
tcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgag

SEQ ID NO: 6466 - DNA, 401 bp, Homo sapiens
  chr2:171671389-171671790
  hyper
gaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcac

SEQ ID NO: 6467 - DNA, 18 bp, Homo sapiens
  chr2:171671799-171671817
  hyper
cgccgtttaggatgtttt

SEQ ID NO: 6468 - DNA, 79 bp, Homo sapiens
  chr2:171674129-171674208
  hyper
agagtcgagcaggggcgccgcgcaagatctttgtccgccgcctcctgcgcgctgcgcgcaagttcgtttccccggtgac

SEQ ID NO: 6469 - DNA, 129 bp, Homo sapiens
  chr2:171674744-171674873
  hyper
accccgaccccgcctcgtctcggcgcttcactccaggtcgcgccgatgcaccgccagactcgagagcggcccagggctacgctccctgcgccccagtaccggagctagcgcgcacgtctcctccgctgc

SEQ ID NO: 6470 - DNA, 22 bp, Homo sapiens
  chr2:171675361-171675383
  hyper
tgactcccagggcaccggaaag

SEQ ID NO: 6471 - DNA, 131 bp, Homo sapiens; identical to SEQ ID NO: 214
  chr2:171675522-171675653
  hyper

SEQ ID NO: 6472 - DNA, 36 bp, Homo sapiens
  chr2:171678013-171678049
  hyper
tgaagagcagccatgcgagcccgatcatctagtcaa

SEQ ID NO: 6473 - DNA, 30 bp, Homo sapiens
  chr2:172945137-172945167
  hyper
gccgcccgaaggtcgcggtgacctggtgcc

SEQ ID NO: 6474 - DNA, 329 bp, Homo sapiens; identical to SEQ ID NO: 215
  chr2:172945896-172946225
  hyper

SEQ ID NO: 6475 - DNA, 141 bp, Homo sapiens
  chr2:172947773-172947914
  hyper
ggtcccctgtgctaccgcaaaagtctttgatccttttccagctgtggacacagagcacccaagagactgtcgcgatgtgcggccgtctctccccttcccccaccttgcaagtctctggaatacactgtccctaggcggccc

SEQ ID NO: 6476 - DNA, 95 bp, Homo sapiens
  chr2:172948219-172948314
  hyper
gctacaaagcctcaccgtgtggttcggtgattaagaaaaaaaaaatcttttaaacgttggcaaacccgttattggtttggcgtattgggtttttt

SEQ ID NO: 6477 - DNA, 56 bp, Homo sapiens; identical to SEQ ID NO: 2081
  chr2:172949227-172949283
  hyper

SEQ ID NO: 6478 - DNA, 499 bp, Homo sapiens; identical to SEQ ID NO: 2082
  chr2:172949348-172949847
  hyper

SEQ ID NO: 6479 - DNA, 141 bp, Homo sapiens
  chr2:172950071-172950212
  hyper
tacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 6480 - DNA, 292 bp, Homo sapiens
  chr2:172951251-172951543
  hyper
tcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagaggg

SEQ ID NO: 6481 - DNA, 158 bp, Homo sapiens
  chr2:172952393-172952551
  hyper
aggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 6482 - DNA, 323 bp, Homo sapiens; identical to SEQ ID NO: 216
  chr2:172955471-172955794
  hyper

SEQ ID NO: 6483 - DNA, 59 bp, Homo sapiens; identical to SEQ ID NO: 217
  chr2:172957976-172958035
  hyper

SEQ ID NO: 6484 - DNA, 335 bp, Homo sapiens
  chr2:172961325-172961660
  hyper
gcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcg

SEQ ID NO: 6485 - DNA, 94 bp, Homo sapiens; identical to SEQ ID NO: 218
  chr2:172964795-172964889
  hyper

SEQ ID NO: 6486 - DNA, 4 bp, Homo sapiens
  chr2:172965295-172965299
  hyper
gggg

SEQ ID NO: 6487 - DNA, 116 bp, Homo sapiens; identical to SEQ ID NO: 220
  chr2:172965647-172965763
  hyper

SEQ ID NO: 6488 - DNA, 802 bp, Homo sapiens; identical to SEQ ID NO: 221
  chr2:172966250-172967052
  hyper

SEQ ID NO: 6489 - DNA, 395 bp, Homo sapiens
  chr2:172970975-172971370
  hyper
gagaggacaagtctgcgctttgctctcagacccttgccccaccgctagcctggggcaggattccagccttcgcctagccgggcgctttgctctgccgggctattgggcgtcctccgctgcacagaaagccagcccagttgggtattactggggagaggatgcctcctgtcggcagggagctagggtgggcgcccgggtgccctcagtgcgtggcggggccaggcccattttcactctccttcctcactcgggggatgggagggctgcatgcgctgctgctcctactcctcacagtctcgtcgagggtcccggagacgggagtttccgggccgctggtccaagaggcaatgccagtttcggtacctttgtgttttcgtccccgaagtagtagctct

SEQ ID NO: 6490 - DNA, 269 bp, Homo sapiens
  chr2:172972981-172973250
  hyper
ggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggctt

SEQ ID NO: 6491 - DNA, 356 bp, Homo sapiens
  chr2:173099741-173100097
  hyper
cagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 6492 - DNA, 194 bp, Homo sapiens
  chr2:173100098-173100292
  hyper
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtata

SEQ ID NO: 6493 - DNA, 90 bp, Homo sapiens
  chr2:173600600-173600690
  hyper
ggcgtccgggaggagcggggtccgcgcggcggacgaggcgggggcggaggcgcaggcagagcgagcgcgggaggtcgccgcagccaggga

SEQ ID NO: 6494 - DNA, 1168 bp, Homo sapiens; identical to SEQ ID NO: 222
  chr2:175190805-175191973
  hyper

SEQ ID NO: 6495 - DNA, 149 bp, Homo sapiens; identical to SEQ ID NO: 223
  chr2:175192084-175192233
  hyper

SEQ ID NO: 6496 - DNA, 83 bp, Homo sapiens; identical to SEQ ID NO: 224
  chr2:175193294-175193377
  hyper

SEQ ID NO: 6497 - DNA, 267 bp, Homo sapiens; identical to SEQ ID NO: 225
  chr2:175193378-175193645
  hyper

SEQ ID NO: 6498 - DNA, 35 bp, Homo sapiens; identical to SEQ ID NO: 226
  chr2:175193808-175193843
  hyper

SEQ ID NO: 6499 - DNA, 86 bp, Homo sapiens
  chr2:175197089-175197175
  hyper
attgtgatgcagacgcgtgtatctaaaggaatatgcgagtgcccacgtctagagtctgacagctggaactacggggaaaacggcgg

SEQ ID NO: 6500 - DNA, 90 bp, Homo sapiens; identical to SEQ ID NO: 227
  chr2:175199465-175199555
  hyper

SEQ ID NO: 6501 - DNA, 8 bp, Homo sapiens
  chr2:175199921-175199929
  hyper
ggagaaac

SEQ ID NO: 6502 - DNA, 181 bp, Homo sapiens; identical to SEQ ID NO: 229
  chr2:175200260-175200441
  hyper

SEQ ID NO: 6503 - DNA, 144 bp, Homo sapiens; identical to SEQ ID NO: 230
  chr2:175200709-175200853
  hyper

SEQ ID NO: 6504 - DNA, 267 bp, Homo sapiens; identical to SEQ ID NO: 231
  chr2:175200916-175201183
  hyper

SEQ ID NO: 6505 - DNA, 183 bp, Homo sapiens; identical to SEQ ID NO: 232
  chr2:175201359-175201542
  hyper

SEQ ID NO: 6506 - DNA, 54 bp, Homo sapiens; identical to SEQ ID NO: 233
  chr2:175201775-175201829
  hyper

SEQ ID NO: 6507 - DNA, 120 bp, Homo sapiens; identical to SEQ ID NO: 234
  chr2:175202126-175202246
  hyper

SEQ ID NO: 6508 - DNA, 33 bp, Homo sapiens; identical to SEQ ID NO: 235
  chr2:175202568-175202601
  hyper

SEQ ID NO: 6509 - DNA, 78 bp, Homo sapiens; identical to SEQ ID NO: 236
  chr2:175202633-175202711
  hyper

SEQ ID NO: 6510 - DNA, 30 bp, Homo sapiens
  chr2:175203142-175203172
  hyper
taaagaaattaaatgcgtttatctgtatca

SEQ ID NO: 6511 - DNA, 119 bp, Homo sapiens; identical to SEQ ID NO: 237
  chr2:175204828-175204947
  hyper

SEQ ID NO: 6512 - DNA, 58 bp, Homo sapiens
  chr2:175206848-175206906
  hyper
cggctggaaccaggccgattcaaacaggccaccaaaccatcccacccccctaccccct

SEQ ID NO: 6513 - DNA, 606 bp, Homo sapiens
  chr2:175206960-175207566
  hyper
cgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtat

SEQ ID NO: 6514 - DNA, 558 bp, Homo sapiens; identical to SEQ ID NO: 238
  chr2:175208311-175208869
  hyper

SEQ ID NO: 6515 - DNA, 93 bp, Homo sapiens; identical to SEQ ID NO: 239
  chr2:175208996-175209089
  hyper

SEQ ID NO: 6516 - DNA, 30 bp, Homo sapiens
  chr2:175547125-175547155
  hyper
cgcgaagcccctgctcgagacctacggaga

SEQ ID NO: 6517 - DNA, 201 bp, Homo sapiens
  chr2:175547440-175547641
  hyper
gtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaac

SEQ ID NO: 6518 - DNA, 148 bp, Homo sapiens; identical to SEQ ID NO: 2107
  chr2:176940167-176940315
  hyper

SEQ ID NO: 6519 - DNA, 43 bp, Homo sapiens
  chr2:176943640-176943683
  hyper
aacccctccagtagccgggttggcagagcgggtctcagcaacc

SEQ ID NO: 6520 - DNA, 59 bp, Homo sapiens; identical to SEQ ID NO: 240
  chr2:176944346-176944405
  hyper

SEQ ID NO: 6521 - DNA, 391 bp, Homo sapiens; identical to SEQ ID NO: 241
  chr2:176944456-176944847
  hyper

SEQ ID NO: 6522 - DNA, 132 bp, Homo sapiens; identical to SEQ ID NO: 242
  chr2:176945137-176945269
  hyper

SEQ ID NO: 6523 - DNA, 203 bp, Homo sapiens; identical to SEQ ID NO: 243
  chr2:176945581-176945784
  hyper

SEQ ID NO: 6524 - DNA, 30 bp, Homo sapiens
  chr2:176947306-176947336
  hyper
cttacaaattgctgccgttaatggaatcaa

SEQ ID NO: 6525 - DNA, 140 bp, Homo sapiens
  chr2:176947763-176947903
  hyper
cggctgctgactaggggtctaccggctcgctcgggctcttagacacgagcgcagaaacattttctcggactcaggagcgagggcgggtgggcctggtgttccaggctccgcaggcctgagcctggcgggaaagctcaagg

SEQ ID NO: 6526 - DNA, 227 bp, Homo sapiens
  chr2:176948848-176949075
  hyper
gatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 6527 - DNA, 43 bp, Homo sapiens; identical to SEQ ID NO: 2112
  chr2:176949959-176950002
  hyper

SEQ ID NO: 6528 - DNA, 184 bp, Homo sapiens; identical to SEQ ID NO: 2113
  chr2:176950074-176950258
  hyper

SEQ ID NO: 6529 - DNA, 30 bp, Homo sapiens
  chr2:176952943-176952973
  hyper
cacgggtgcaggtttcgctgcataagggaa

SEQ ID NO: 6530 - DNA, 69 bp, Homo sapiens
  chr2:176957047-176957116
  hyper
tgcaactcggggagccgaggagaggtggcaaaaacagcggttgccgagacaaggcgcaggccttggcgc

SEQ ID NO: 6531 - DNA, 68 bp, Homo sapiens; identical to SEQ ID NO: 244
  chr2:176957347-176957415
  hyper

SEQ ID NO: 6532 - DNA, 53 bp, Homo sapiens; identical to SEQ ID NO: 245
  chr2:176957576-176957629
  hyper

SEQ ID NO: 6533 - DNA, 207 bp, Homo sapiens; identical to SEQ ID NO: 246
  chr2:176957914-176958121
  hyper

SEQ ID NO: 6534 - DNA, 52 bp, Homo sapiens; identical to SEQ ID NO: 2117
  chr2:176958391-176958443
  hyper

SEQ ID NO: 6535 - DNA, 298 bp, Homo sapiens; identical to SEQ ID NO: 247
  chr2:176959213-176959511
  hyper

SEQ ID NO: 6536 - DNA, 30 bp, Homo sapiens
  chr2:176963448-176963478
  hyper
tgagcacaccgctcccggctaagaactgct

SEQ ID NO: 6537 - DNA, 213 bp, Homo sapiens; identical to SEQ ID NO: 2119
  chr2:176964389-176964602
  hyper

SEQ ID NO: 6538 - DNA, 36 bp, Homo sapiens
  chr2:176965474-176965510
  hyper
tggcgctctactagccgcgcgcgtggccagggccgg

SEQ ID NO: 6539 - DNA, 48 bp, Homo sapiens
  chr2:176969256-176969304
  hyper
cggagcggctggctgcgccccgaaggcctggtgcgctccctgcgtttc

SEQ ID NO: 6540 - DNA, 35 bp, Homo sapiens; identical to SEQ ID NO: 2120
  chr2:176969579-176969614
  hyper

SEQ ID NO: 6541 - DNA, 69 bp, Homo sapiens; identical to SEQ ID NO: 2121
  chr2:176969676-176969745
  hyper

SEQ ID NO: 6542 - DNA, 30 bp, Homo sapiens
  chr2:176971402-176971432
  hyper
tggcgaaattactcccgcccggtgaacaag

SEQ ID NO: 6543 - DNA, 30 bp, Homo sapiens
  chr2:176972908-176972938
  hyper
gggagggggggggggcggaggcctccctct

SEQ ID NO: 6544 - DNA, 105 bp, Homo sapiens; identical to SEQ ID NO: 2122
  chr2:176976065-176976170
  hyper

SEQ ID NO: 6545 - DNA, 168 bp, Homo sapiens; identical to SEQ ID NO: 248
  chr2:176980770-176980938
  hyper

SEQ ID NO: 6546 - DNA, 130 bp, Homo sapiens; identical to SEQ ID NO: 249
  chr2:176981376-176981506
  hyper

SEQ ID NO: 6547 - DNA, 30 bp, Homo sapiens
  chr2:176982584-176982614
  hyper
cgcaaaggagacctgcggctcataaacacg

SEQ ID NO: 6548 - DNA, 30 bp, Homo sapiens
  chr2:176983753-176983783
  hyper
acactaagcaccaaacgctggaattagaaa

SEQ ID NO: 6549 - DNA, 504 bp, Homo sapiens; identical to SEQ ID NO: 2125
  chr2:176986711-176987215
  hyper

SEQ ID NO: 6550 - DNA, 277 bp, Homo sapiens; identical to SEQ ID NO: 2126
  chr2:176993514-176993791
  hyper

SEQ ID NO: 6551 - DNA, 256 bp, Homo sapiens; identical to SEQ ID NO: 2127
  chr2:176994124-176994380
  hyper

SEQ ID NO: 6552 - DNA, 63 bp, Homo sapiens; identical to SEQ ID NO: 2128
  chr2:176994497-176994560
  hyper

SEQ ID NO: 6553 - DNA, 288 bp, Homo sapiens
  chr2:176995380-176995668
  hyper
ccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 6554 - DNA, 38 bp, Homo sapiens
  chr2:176996261-176996299
  hyper
gcaggaggtgaaggacggggaaacgaaaaaggaagccc

SEQ ID NO: 6555 - DNA, 57 bp, Homo sapiens; identical to SEQ ID NO: 250
  chr2:177001206-177001263
  hyper

SEQ ID NO: 6556 - DNA, 432 bp, Homo sapiens; identical to SEQ ID NO: 251
  chr2:177001264-177001696
  hyper

SEQ ID NO: 6557 - DNA, 75 bp, Homo sapiens; identical to SEQ ID NO: 252
  chr2:177001781-177001856
  hyper

SEQ ID NO: 6558 - DNA, 101 bp, Homo sapiens
  chr2:177004982-177005083
  hyper
ttcaggccaatccttcggcctgaccattcccggatcttgttatgccagcacagcacattcgagggctctggggggcagcagctcggcgaagagcagtcaaa

SEQ ID NO: 6559 - DNA, 35 bp, Homo sapiens
  chr2:177005582-177005617
  hyper
ctgggagcctagggccgttccgggttggcgggcca

SEQ ID NO: 6560 - DNA, 55 bp, Homo sapiens
  chr2:177042646-177042701
  hyper
tccctcaatccccctcggttaccccttggggcagcaacgacgccatcccagcccc

SEQ ID NO: 6561 - DNA, 73 bp, Homo sapiens; identical to SEQ ID NO: 2132
  chr2:177042926-177042999
  hyper

SEQ ID NO: 6562 - DNA, 82 bp, Homo sapiens
  chr2:177043427-177043509
  hyper
gcctgcacccacacccgcccctgagccacagtgaccttgcattccccgccccctgccacacctcctgcgtgcccgagtgtca

SEQ ID NO: 6563 - DNA, 56 bp, Homo sapiens
  chr2:177053379-177053435
  hyper
tacctccggctcactcgccatgggttggagagggcagctcgggtagagagggctgg

SEQ ID NO: 6564 - DNA, 85 bp, Homo sapiens
  chr2:177053618-177053703
  hyper
cgacgcccggcccgtggctctgcagcccgccttccctctgggcaacggcgacggcgccttcgtcagctgtctgcccctggccgcc

SEQ ID NO: 6565 - DNA, 19 bp, Homo sapiens
  chr2:177053935-177053954
  hyper
cctcggccgtcttctcggg

SEQ ID NO: 6566 - DNA, 364 bp, Homo sapiens; identical to SEQ ID NO: 254
  chr2:177053999-177054363
  hyper

SEQ ID NO: 6567 - DNA, 60 bp, Homo sapiens
  chr2:177502788-177502848
  hyper
ccgccgcgggcagggcgctccgctcccggaccccgaatctgaaagcggagaccaagggct

SEQ ID NO: 6568 - DNA, 30 bp, Homo sapiens
  chr2:179278479-179278509
  hyper
tcgtgcttggttttccggaccttgcttcct

SEQ ID NO: 6569 - DNA, 51 bp, Homo sapiens
  chr2:179278710-179278761
  hyper
cacaaaaagcaggaacgagtagcggtggctgaagaacgagcaggagcttga

SEQ ID NO: 6570 - DNA, 487 bp, Homo sapiens
  chr2:180725172-180725659
  hyper
ccctccccttctcctcgtcccttccgcagtcccacagtgtcctcccacccttccctgacaccttcaccagcgcttagtggccgaggccgcccgtcagggctcccaacaagtgcaaacttcggggaccttctctctgctcctctgcccccatctcatctgggttctgctgcagaactctcccacgaccccaagcttcgaccgctaccctcctcacacacctcggtcccctaactacccatttcccggtcattgagagaaagacaaaccccaaacttccagcccaggtgacgaggcgctgcggctaaacatagcggggcactctcctcgtcctttcccctctccatccgtccttgggaattggagcctaccctggggaacagaggagtatgctcctgtggcttccacgacctaatcctaactccagggactcgcaggagttaggattaggtcgtggaagccacaggcgcctgggcgccctcctctacaa

SEQ ID NO: 6571 - DNA, 35 bp, Homo sapiens
  chr2:180726046-180726081
  hyper
tgtccaactcttgcccgcgccgggcttaagcgccc

SEQ ID NO: 6572 - DNA, 158 bp, Homo sapiens; identical to SEQ ID NO: 255
  chr2:182321397-182321555
  hyper

SEQ ID NO: 6573 - DNA, 27 bp, Homo sapiens
  chr2:182321811-182321838
  hyper
ctggcatttgggccacgccgggctggg

SEQ ID NO: 6574 - DNA, 154 bp, Homo sapiens; identical to SEQ ID NO: 257
  chr2:182322038-182322192
  hyper

SEQ ID NO: 6575 - DNA, 631 bp, Homo sapiens; identical to SEQ ID NO: 258
  chr2:182322399-182323030
  hyper

SEQ ID NO: 6576 - DNA, 440 bp, Homo sapiens; identical to SEQ ID NO: 2139
  chr2:182542878-182543318
  hyper

SEQ ID NO: 6577 - DNA, 397 bp, Homo sapiens; identical to SEQ ID NO: 2140
  chr2:182545388-182545785
  hyper

SEQ ID NO: 6578 - DNA, 84 bp, Homo sapiens; identical to SEQ ID NO: 2141
  chr2:182546001-182546085
  hyper

SEQ ID NO: 6579 - DNA, 47 bp, Homo sapiens
  chr2:182546488-182546535
  hyper
tgctcccctcagtctcgggtctgtataagatacttgattcagacaag

SEQ ID NO: 6580 - DNA, 495 bp, Homo sapiens; identical to SEQ ID NO: 259
  chr2:182547437-182547932
  hyper

SEQ ID NO: 6581 - DNA, 100 bp, Homo sapiens; identical to SEQ ID NO: 260
  chr2:182548061-182548161
  hyper

SEQ ID NO: 6582 - DNA, 30 bp, Homo sapiens
  chr2:182548451-182548481
  hyper
ccgcgggaaggggggcgggaggaggcgtgt

SEQ ID NO: 6583 - DNA, 55 bp, Homo sapiens
  chr2:182548734-182548789
  hyper
gcaaagggaggtttgcgttcaatgaaaggatcaagtgtggccagggcagcccggc

SEQ ID NO: 6584 - DNA, 15 bp, Homo sapiens
  chr2:182548819-182548834
  hyper
cgccctgcctaggag

SEQ ID NO: 6585 - DNA, 366 bp, Homo sapiens; identical to SEQ ID NO: 2144
  chr2:182549088-182549454
  hyper

SEQ ID NO: 6586 - DNA, 30 bp, Homo sapiens
  chr2:182550094-182550124
  hyper
ttgggagagaggacccggacaagttcctaa

SEQ ID NO: 6587 - DNA, 301 bp, Homo sapiens
  chr2:182819048-182819349
  hyper
cccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 6588 - DNA, 110 bp, Homo sapiens; identical to SEQ ID NO: 2145
  chr2:183731222-183731332
  hyper

SEQ ID NO: 6589 - DNA, 640 bp, Homo sapiens; identical to SEQ ID NO: 2146
  chr2:183731466-183732106
  hyper

SEQ ID NO: 6590 - DNA, 158 bp, Homo sapiens
  chr2:185462831-185462989
  hyper
tcttgagaaagaagccgctgctggcaccggcctggattcgctgcagtcggaagcgggtggctttcggtattgaattattaatttatttatccccctcgcccccacccccacgccgactgccaggcaagaaatcgcggcctcttcgcttcctctccgcc

SEQ ID NO: 6591 - DNA, 500 bp, Homo sapiens; identical to SEQ ID NO: 2147
  chr2:185463255-185463755
  hyper

SEQ ID NO: 6592 - DNA, 61 bp, Homo sapiens
  chr2:186603457-186603518
  hyper
ccgcccttctggggccgctaccattggaagcctggaacgcggggggcggggctgaggtcgt

SEQ ID NO: 6593 - DNA, 293 bp, Homo sapiens; identical to SEQ ID NO: 2148
  chr2:193059025-193059318
  hyper

SEQ ID NO: 6594 - DNA, 165 bp, Homo sapiens; identical to SEQ ID NO: 2149
  chr2:193059344-193059509
  hyper

SEQ ID NO: 6595 - DNA, 707 bp, Homo sapiens; identical to SEQ ID NO: 2150
  chr2:193059734-193060441
  hyper

SEQ ID NO: 6596 - DNA, 271 bp, Homo sapiens; identical to SEQ ID NO: 2151
  chr2:193060675-193060946
  hyper

SEQ ID NO: 6597 - DNA, 423 bp, Homo sapiens
  chr2:197457404-197457827
  hyper
tggcaaatgaatgaccgcgccggggcgcaagggaggaaaaacaaagccacctcccgccgtccgctacctgcggcgagggccgcgcgctcacctgggctttgcgcccgtcgccacaagctgcgggtggggacccggccgcggggcgggagggcgcccccaaagtcgcccggacccgcggccccggcgccctgcggccggtccgtgcgcgccgaggagaaagcaggcggccgggggcgccgccgcgcgttgcatgcagctcacggctgctgcggccgctgccacggagccgagagtctctgcgctgcagtccccgaccccgagaccgcgagaagcgcccggagagacgcggcgcaggggcagagcgcgctcggcgcgcccctcagcggctcttcccgccgccctccgcagcgggctgggtctcgg

SEQ ID NO: 6598 - DNA, 66 bp, Homo sapiens
  chr2:197458195-197458261
  hyper
ccggtccgcggagagcgaagagtccggcctcctcacctccagccgcgccggcgcccttcccgctag

SEQ ID NO: 6599 - DNA, 30 bp, Homo sapiens
  chr2:198651504-198651534
  hyper
agcgggtcccggccccgctgagcacctcca

SEQ ID NO: 6600 - DNA, 29 bp, Homo sapiens
  chr2:200327423-200327452
  hyper
ggaggtagagactgtggaggtcctcctcc

SEQ ID NO: 6601 - DNA, 46 bp, Homo sapiens
  chr2:200328258-200328304
  hyper
ggcccggagccccagcgtcctctcccgacagcgccaccgcgtgggc

SEQ ID NO: 6602 - DNA, 365 bp, Homo sapiens; identical to SEQ ID NO: 2153
  chr2:200329029-200329394
  hyper

SEQ ID NO: 6603 - DNA, 262 bp, Homo sapiens; identical to SEQ ID NO: 2154
  chr2:200329432-200329694
  hyper

SEQ ID NO: 6604 - DNA, 30 bp, Homo sapiens
  chr2:200334190-200334220
  hyper
cagctctgggatacccgctcagtacagaca

SEQ ID NO: 6605 - DNA, 49 bp, Homo sapiens; identical to SEQ ID NO: 2155
  chr2:200335076-200335125
  hyper

SEQ ID NO: 6606 - DNA, 33 bp, Homo sapiens
  chr2:200335771-200335804
  hyper
ctgttgtgtcagaatcggcgagtgcaaagtagc

SEQ ID NO: 6607 - DNA, 82 bp, Homo sapiens
  chr2:200336264-200336346
  hyper
gaagcctccaaggagcgggcggctgggagaggttgtgccacccgggaccaagccatcggcgctgctccggactcccggtagg

SEQ ID NO: 6608 - DNA, 217 bp, Homo sapiens; identical to SEQ ID NO: 2156
  chr2:201450490-201450707
  hyper

SEQ ID NO: 6609 - DNA, 67 bp, Homo sapiens
  chr2:202899715-202899782
  hyper
gccatcccgccgtgtcgttctctgtgcgagcgcgcccgccagggctgcgaggcgctcatgaacaagt

SEQ ID NO: 6610 - DNA, 74 bp, Homo sapiens
  chr2:206550451-206550525
  hyper
gcgcggcaggctcgccgcgacccctagagagacggctttgagtggcgggaggccgaggccggctggcttgggaa

SEQ ID NO: 6611 - DNA, 206 bp, Homo sapiens
  chr2:206551071-206551277
  hyper
cgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttccca

SEQ ID NO: 6612 - DNA, 40 bp, Homo sapiens; identical to SEQ ID NO: 2157
  chr2:207139115-207139155
  hyper

SEQ ID NO: 6613 - DNA, 606 bp, Homo sapiens; identical to SEQ ID NO: 2158
  chr2:207139217-207139823
  hyper

SEQ ID NO: 6614 - DNA, 30 bp, Homo sapiens
  chr2:207140134-207140164
  hyper
ggcctttcccagcctcgggcgattatagtt

SEQ ID NO: 6615 - DNA, 15 bp, Homo sapiens
  chr2:207307463-207307478
  hyper
tctgtattgcttccc

SEQ ID NO: 6616 - DNA, 182 bp, Homo sapiens
  chr2:207307547-207307729
  hyper
cggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctc

SEQ ID NO: 6617 - DNA, 169 bp, Homo sapiens
  chr2:207308045-207308214
  hyper
ctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcc

SEQ ID NO: 6618 - DNA, 418 bp, Homo sapiens
  chr2:207308502-207308920
  hyper
cggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccc

SEQ ID NO: 6619 - DNA, 310 bp, Homo sapiens; identical to SEQ ID NO: 2159
  chr2:207506759-207507069
  hyper

SEQ ID NO: 6620 - DNA, 75 bp, Homo sapiens
  chr2:208546197-208546272
  hyper
cgccgcggagccgcgcggagcggagccggcgagctaacccgagccagccggcgggcgtcccggaggcggcggcgc

SEQ ID NO: 6621 - DNA, 30 bp, Homo sapiens
  chr2:208635667-208635697
  hyper
ggcaaccctgggattcgaacccaggtagtt

SEQ ID NO: 6622 - DNA, 40 bp, Homo sapiens
  chr2:210636466-210636506
  hyper
tccggccgtgcagcccggcgcgggccgctgtccacagtgg

SEQ ID NO: 6623 - DNA, 140 bp, Homo sapiens
  chr2:210636737-210636877
  hyper
cggcggctagcgaggagacagagctgggtcctgcagtaggactcccgggagccaccattatggtgaagaggaagagctccgagggccaggagcaggacggcggccgcggcatccccctgcccatccagaccttcctgtgg

SEQ ID NO: 6624 - DNA, 124 bp, Homo sapiens
  chr2:211089565-211089689
  hyper
caaaacgcaggctcccgggtcccactgcaggccgctgaactagacgggttggattggggctccggaatgaacttctggagaaatctttcggctttccccgacgtgggctcggcggtctgttctc

SEQ ID NO: 6625 - DNA, 104 bp, Homo sapiens
  chr2:213401235-213401339
  hyper
ggaacaacaatggcacgctaatcctcgcgctctaaatgggctcacttgtgggtctgacaattcgcccagggaaacgagaagagacgaagcgagggcgcgagcta

SEQ ID NO: 6626 - DNA, 182 bp, Homo sapiens
  chr2:213401654-213401836
  hyper
atgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaactt

SEQ ID NO: 6627 - DNA, 695 bp, Homo sapiens; identical to SEQ ID NO: 2160
  chr2:213402687-213403382
  hyper

SEQ ID NO: 6628 - DNA, 88 bp, Homo sapiens
  chr2:213403913-213404001
  hyper
aaaaaaaaaaaggtgcggggggcggtgggaataaaacaaccctccacgcaaccaggccggctctgctcagccgcgcaaaccccgccca

SEQ ID NO: 6629 - DNA, 32 bp, Homo sapiens
  chr2:216300252-216300284
  hyper
tttctctcagtaaagcgcgcacacactcgcac

SEQ ID NO: 6630 - DNA, 30 bp, Homo sapiens
  chr2:216301757-216301787
  hyper
ctttcccacgttcaccgtgccagttacaca

SEQ ID NO: 6631 - DNA, 356 bp, Homo sapiens
  chr2:217559066-217559422
  hyper
cgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagt

SEQ ID NO: 6632 - DNA, 93 bp, Homo sapiens; identical to SEQ ID NO: 2161
  chr2:218806209-218806302
  hyper

SEQ ID NO: 6633 - DNA, 45 bp, Homo sapiens
  chr2:219735785-219735830
  hyper
atctgcaggaaggcacggcggctggccgggcggcaggccgagttg

SEQ ID NO: 6634 - DNA, 394 bp, Homo sapiens; identical to SEQ ID NO: 262
  chr2:219736151-219736545
  hyper

SEQ ID NO: 6635 - DNA, 30 bp, Homo sapiens
  chr2:219773737-219773767
  hyper
caacctcaaccaacacgtaggcgaggatgc

SEQ ID NO: 6636 - DNA, 304 bp, Homo sapiens
  chr2:219824786-219825090
  hyper
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccac

SEQ ID NO: 6637 - DNA, 36 bp, Homo sapiens
  chr2:219825513-219825549
  hyper
cctcaagaacgagggcgaggccgccgccagcggcgg

SEQ ID NO: 6638 - DNA, 92 bp, Homo sapiens
  chr2:219846666-219846758
  hyper
cggcggcggcatgagcgtgcgcgggcggcggctggcaggcctgcgccaggccctggaagtcgaagcggtaggcgtagcgcttgccatgcacc

SEQ ID NO: 6639 - DNA, 103 bp, Homo sapiens
  chr2:219847047-219847150
  hyper
gaaactgacccaccccggcaggaaccggcactgggggaggaaaagtgcaagtcaaactgcagctgcgttcggcgggagaggccggccccggaggggctgatca

SEQ ID NO: 6640 - DNA, 83 bp, Homo sapiens
  chr2:219848809-219848892
  hyper
tcttcccaaggcctccgcacaaccaggccaggactccgggcttcagtgtgaaccctgggtccacactgctcccacctactgtc

SEQ ID NO: 6641 - DNA, 542 bp, Homo sapiens
  chr2:219848935-219849477
  hyper
cgcgccggccatctcacctttctgaaccgcggggctcagcggcccccagctcgggttcttcccgtccttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 6642 - DNA, 61 bp, Homo sapiens
  chr2:219850168-219850229
  hyper
cagccccccgcgccccgcagccggggagacgcgcgggggatgggcccgggccatgtgccct

SEQ ID NO: 6643 - DNA, 58 bp, Homo sapiens
  chr2:219857911-219857969
  hyper
ggaagggtggcaccacgcgctcagcgtctcaagagccccgtttcgagccacacacagc

SEQ ID NO: 6644 - DNA, 40 bp, Homo sapiens
  chr2:219867872-219867912
  hyper
gcggcagggcgatgacgcgtggccgcgaggtgagtaccac

SEQ ID NO: 6645 - DNA, 231 bp, Homo sapiens; identical to SEQ ID NO: 2163
  chr2:220174065-220174296
  hyper

SEQ ID NO: 6646 - DNA, 280 bp, Homo sapiens; identical to SEQ ID NO: 2164
  chr2:220196354-220196634
  hyper

SEQ ID NO: 6647 - DNA, 50 bp, Homo sapiens
  chr2:220197440-220197490
  hyper
accagcccgcgactccgaatctgtttaaccctcctcggcagttcagccaa

SEQ ID NO: 6648 - DNA, 268 bp, Homo sapiens
  chr2:220222947-220223215
  hyper
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagcc

SEQ ID NO: 6649 - DNA, 30 bp, Homo sapiens
  chr2:220223590-220223620
  hyper
ggtggggactaatggcgtcccagccccccg

SEQ ID NO: 6650 - DNA, 36 bp, Homo sapiens
  chr2:220283254-220283290
  hyper
tcccactcggctccccgctgagttcgcccgtgttcc

SEQ ID NO: 6651 - DNA, 39 bp, Homo sapiens
  chr2:220283362-220283401
  hyper
cgggcggggccgggggcctggggtcgctgcgggccagcc

SEQ ID NO: 6652 - DNA, 21 bp, Homo sapiens
  chr2:220283711-220283732
  hyper
cgacgtcgagcgcgacaacct

SEQ ID NO: 6653 - DNA, 102 bp, Homo sapiens; identical to SEQ ID NO: 263
  chr2:220299533-220299635
  hyper

SEQ ID NO: 6654 - DNA, 174 bp, Homo sapiens; identical to SEQ ID NO: 264
  chr2:220299885-220300059
  hyper

SEQ ID NO: 6655 - DNA, 618 bp, Homo sapiens; identical to SEQ ID NO: 265
  chr2:220349101-220349719
  hyper

SEQ ID NO: 6656 - DNA, 20 bp, Homo sapiens
  chr2:220361447-220361467
  hyper
aggtaggagatggtgcgctc

SEQ ID NO: 6657 - DNA, 30 bp, Homo sapiens
  chr2:220379221-220379251
  hyper
cagcagaggcagcagcggcagaggcagcac

SEQ ID NO: 6658 - DNA, 1308 bp, Homo sapiens; identical to SEQ ID NO: 2168
  chr2:220416379-220417687
  hyper

SEQ ID NO: 6659 - DNA, 56 bp, Homo sapiens
  chr2:222435807-222435863
  hyper
ccgcgtccgcttccacgcaggcattcgcgcacctacatacacgcagttgcacgcgc

SEQ ID NO: 6660 - DNA, 306 bp, Homo sapiens
  chr2:223155822-223156128
  hyper
cccagcccattgtggcggcgcccgcgggcccgctaggccgagccgggggaggaacagaggcgcccattgagcggccgctgcgcagggcggtgcccacagccccggatgcctcggccaggacttggctcccccggctgcctctgctccagtctcagcgcgggccaggggctagggggattggggatagcgggcggggttcgtgttagtgaaccgcccagccctctcctttctcctgggctatggagctggagggatgtatccagcaagggtgcatcatgcttagcgcgcgcccgttagggagcgcgg

SEQ ID NO: 6661 - DNA, 749 bp, Homo sapiens; identical to SEQ ID NO: 266
  chr2:223158730-223159479
  hyper

SEQ ID NO: 6662 - DNA, 51 bp, Homo sapiens
  chr2:223159710-223159761
  hyper
aaaaacaaaccctcccgtgcgccctctcgctggccccgtgcttgcccctct

SEQ ID NO: 6663 - DNA, 81 bp, Homo sapiens
  chr2:223160035-223160116
  hyper
ggtctcgccaccctccgtccccaggacaagcagctcacccctccctccataaagtgccaagaacaccgggttggcaaatat

SEQ ID NO: 6664 - DNA, 145 bp, Homo sapiens; identical to SEQ ID NO: 267
  chr2:223161540-223161685
  hyper

SEQ ID NO: 6665 - DNA, 220 bp, Homo sapiens; identical to SEQ ID NO: 268
  chr2:223161806-223162026
  hyper

SEQ ID NO: 6666 - DNA, 32 bp, Homo sapiens; identical to SEQ ID NO: 269
  chr2:223162859-223162891
  hyper

SEQ ID NO: 6667 - DNA, 297 bp, Homo sapiens; identical to SEQ ID NO: 270
  chr2:223162928-223163225
  hyper

SEQ ID NO: 6668 - DNA, 337 bp, Homo sapiens; identical to SEQ ID NO: 271
  chr2:223163472-223163809
  hyper

SEQ ID NO: 6669 - DNA, 193 bp, Homo sapiens; identical to SEQ ID NO: 272
  chr2:223163810-223164003
  hyper

SEQ ID NO: 6670 - DNA, 162 bp, Homo sapiens
  chr2:223164417-223164579
  hyper
ttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctct

SEQ ID NO: 6671 - DNA, 15 bp, Homo sapiens
  chr2:223166211-223166226
  hyper
tgtggcctgtgtccc

SEQ ID NO: 6672 - DNA, 371 bp, Homo sapiens
  chr2:223166449-223166820
  hyper
cccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagctt

SEQ ID NO: 6673 - DNA, 300 bp, Homo sapiens; identical to SEQ ID NO: 2176
  chr2:223167250-223167550
  hyper

SEQ ID NO: 6674 - DNA, 361 bp, Homo sapiens
  chr2:223168471-223168832
  hyper
ctccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcc

SEQ ID NO: 6675 - DNA, 450 bp, Homo sapiens
  chr2:223168916-223169366
  hyper
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaa

SEQ ID NO: 6676 - DNA, 224 bp, Homo sapiens
  chr2:223169640-223169864
  hyper
caccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaag

SEQ ID NO: 6677 - DNA, 398 bp, Homo sapiens
  chr2:223170354-223170752
  hyper
cttctttccatccctcggccccctcccagagggcagcgacgaaagccctggccgagcacaaggatcggtgatctgggctcctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttcca

SEQ ID NO: 6678 - DNA, 35 bp, Homo sapiens
  chr2:223171277-223171312
  hyper
cctgttgccccaggacgccccgaaaaactgctctg

SEQ ID NO: 6679 - DNA, 416 bp, Homo sapiens; identical to SEQ ID NO: 273
  chr2:223176096-223176512
  hyper

SEQ ID NO: 6680 - DNA, 307 bp, Homo sapiens; identical to SEQ ID NO: 274
  chr2:223176719-223177026
  hyper

SEQ ID NO: 6681 - DNA, 323 bp, Homo sapiens
  chr2:223177315-223177638
  hyper
tcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccc

SEQ ID NO: 6682 - DNA, 375 bp, Homo sapiens
  chr2:225906404-225906779
  hyper
tgggtttttaccctgcggtgggagggctgttccaagtacatctatttctgcgatagttaacgtcggggggccccagctctaaccagggcgaggaccacggactgcatccctctctctcagcgcactggtctgtttactggagggtgagagggacgcgcagacctccggactcaggggttctgttctgtagatccccccaccccacccggggtctctggcactcgtatcacttagcaccagtgtgactggcggtgcattccggccccctcgcgccccattaaagcccctgcacatcctctcccacgctgcgcttctgctacccacgcagctgctcctctgagcgtcccgcgtgcacaaacgcgcccccggtcctta

SEQ ID NO: 6683 - DNA, 352 bp, Homo sapiens
  chr2:225906790-225907142
  hyper
cgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtc

SEQ ID NO: 6684 - DNA, 57 bp, Homo sapiens
  chr2:228736215-228736272
  hyper
cacctccagaacactcgccccccgcgcgccggagccccgggtcgccaccaaccgccc

SEQ ID NO: 6685 - DNA, 41 bp, Homo sapiens
  chr2:229046219-229046260
  hyper
actcacaacgcggaacggagtttgatcgacatggtattggg

SEQ ID NO: 6686 - DNA, 15 bp, Homo sapiens
  chr2:229046730-229046745
  hyper
ccctgaagttgttca

SEQ ID NO: 6687 - DNA, 232 bp, Homo sapiens; identical to SEQ ID NO: 2179
  chr2:230578195-230578427
  hyper

SEQ ID NO: 6688 - DNA, 123 bp, Homo sapiens
  chr2:231903049-231903172
  hyper
aggcctcgcagctagcggagagcgggccgtgcgtagcggatcgagtctgtcccggaagggtccggagtgcacgggagatgcctagggggcgtgggaaagctgaggggccgagtagaaggcaga

SEQ ID NO: 6689 - DNA, 70 bp, Homo sapiens
  chr2:232394952-232395022
  hyper
ggacggggggcaccccgacggagccctcggacccttcccgccctaggacgaccctgcccgcaccgagccc

SEQ ID NO: 6690 - DNA, 77 bp, Homo sapiens
  chr2:232395054-232395131
  hyper
cgcctgcgcacctaccatgcggcccgcggcccgcgagaccccggcttccaccctccgagcgacggacacagacgcgg

SEQ ID NO: 6691 - DNA, 352 bp, Homo sapiens; identical to SEQ ID NO: 2180
  chr2:232791677-232792029
  hyper

SEQ ID NO: 6692 - DNA, 30 bp, Homo sapiens
  chr2:233283450-233283480
  hyper
cagccccagccctcacggagatgtcagccc

SEQ ID NO: 6693 - DNA, 30 bp, Homo sapiens
  chr2:233283737-233283767
  hyper
cactcaggcggatgacgtagcgcgaggagt

SEQ ID NO: 6694 - DNA, 66 bp, Homo sapiens
  chr2:233285777-233285843
  hyper
gcagcgcggcggcagcggggacctgggtcgggggccgcggagacaggcttccgagggtcgtgcgcg

SEQ ID NO: 6695 - DNA, 277 bp, Homo sapiens; identical to SEQ ID NO: 275
  chr2:233350263-233350540
  hyper

SEQ ID NO: 6696 - DNA, 436 bp, Homo sapiens; identical to SEQ ID NO: 276
  chr2:233350843-233351279
  hyper

SEQ ID NO: 6697 - DNA, 181 bp, Homo sapiens; identical to SEQ ID NO: 277
  chr2:233351415-233351596
  hyper

SEQ ID NO: 6698 - DNA, 351 bp, Homo sapiens; identical to SEQ ID NO: 278
  chr2:233352101-233352452
  hyper

SEQ ID NO: 6699 - DNA, 257 bp, Homo sapiens; identical to SEQ ID NO: 279
  chr2:233352506-233352763
  hyper

SEQ ID NO: 6700 - DNA, 136 bp, Homo sapiens; identical to SEQ ID NO: 280
  chr2:233352775-233352911
  hyper

SEQ ID NO: 6701 - DNA, 98 bp, Homo sapiens
  chr2:233368141-233368239
  hyper
tataggtcaatgtcccgctcagcctccctcccccagcaccgtgaggaccgaggcctggggcctggcgcccgcctggtggacctcgggggcaggctggg

SEQ ID NO: 6702 - DNA, 85 bp, Homo sapiens
  chr2:233388723-233388808
  hyper
gctccgactcctgtccggtccgcagagctgcgctcgctggcgcacacgctgctgggcctgctgcggaacgcgcaggagctgctcg

SEQ ID NO: 6703 - DNA, 30 bp, Homo sapiens
  chr2:233389121-233389151
  hyper
gggcctggacgaggtcggaagcgcttctac

SEQ ID NO: 6704 - DNA, 131 bp, Homo sapiens
  chr2:233498345-233498476
  hyper
cgcgccgcccgccagctccctgcgtcccgtcccgcgtccccgcgttcccgcgtcctgcgatccgccgccatggccagtgaggagctggcgtgcaagctggagcgccggctgcggcgcgaggaggccgagga

SEQ ID NO: 6705 - DNA, 164 bp, Homo sapiens
  chr2:233498710-233498874
  hyper
caaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatct

SEQ ID NO: 6706 - DNA, 86 bp, Homo sapiens
  chr2:233498895-233498981
  hyper
cgaagaggggggacaccaggagcaggagctctccgggacggagcccaaaagttctcggcggctgccgggcccgagttccaggtccc

SEQ ID NO: 6707 - DNA, 30 bp, Homo sapiens
  chr2:233499209-233499239
  hyper
ggagtttggtaaagtcgttgtaagagattc

SEQ ID NO: 6708 - DNA, 51 bp, Homo sapiens
  chr2:233740999-233741050
  hyper
cctgctggccacctgcgtggtgctggcgctcgtggtcgtcgcgctgagaaa

SEQ ID NO: 6709 - DNA, 100 bp, Homo sapiens
  chr2:233741381-233741481
  hyper
ggagtgcctcaggagcgcgccgcatgtgcgtgcccggtgcgcgtgcgccggggccgccagggcatcggagcgggtgtgcggccagcggtcttagcccgtc

SEQ ID NO: 6710 - DNA, 117 bp, Homo sapiens
  chr2:235404416-235404533
  hyper
gggtggggggcaggtcgagagtaggccggtaaatcagacttcgcagctccttaagtcaccagtcctgcatttgggtgcagagattccgttttaaaaattcgaagcatcgctttggtt

SEQ ID NO: 6711 - DNA, 13 bp, Homo sapiens
  chr2:235404550-235404563
  hyper
cgcgggttctcgc

SEQ ID NO: 6712 - DNA, 26 bp, Homo sapiens
  chr2:235404623-235404649
  hyper
cgctcgctccccggtcgctccgggcg

SEQ ID NO: 6713 - DNA, 1 bp, Homo sapiens
  chr2:237068552-237068553
  hyper
t

SEQ ID NO: 6714 - DNA, 16 bp, Homo sapiens
  chr2:237068925-237068941
  hyper
gcggtggaggctaggg

SEQ ID NO: 6715 - DNA, 357 bp, Homo sapiens; identical to SEQ ID NO: 281
  chr2:237072641-237072998
  hyper

SEQ ID NO: 6716 - DNA, 16 bp, Homo sapiens
  chr2:237072999-237073015
  hyper
ctcacactcgctggcc

SEQ ID NO: 6717 - DNA, 440 bp, Homo sapiens; identical to SEQ ID NO: 283
  chr2:237073056-237073496
  hyper

SEQ ID NO: 6718 - DNA, 9 bp, Homo sapiens
  chr2:237073564-237073573
  hyper
cgcttgcct

SEQ ID NO: 6719 - DNA, 39 bp, Homo sapiens
  chr2:237075146-237075185
  hyper
gtcatttggacattccgcgccccccgccccccacccttt

SEQ ID NO: 6720 - DNA, 34 bp, Homo sapiens
  chr2:237076602-237076636
  hyper
cgctgcgctcatagacgcgctcggtagaggccag

SEQ ID NO: 6721 - DNA, 69 bp, Homo sapiens
  chr2:237076656-237076725
  hyper
cgccgcgccgccgccgggaagcccgccggacgccgggagcaccgccgggagcgccgggcaggggccgag

SEQ ID NO: 6722 - DNA, 61 bp, Homo sapiens
  chr2:237078315-237078376
  hyper
ttaaaaatcagctcacgccgaggagctagtggttggggagttggcccgtgttggacgtgtg

SEQ ID NO: 6723 - DNA, 71 bp, Homo sapiens
  chr2:237080210-237080281
  hyper
ggcgcgcttcgctgccgccgccagagtcgaggtaacgggtggtcgtggagagggtacggtgtggccacccg

SEQ ID NO: 6724 - DNA, 118 bp, Homo sapiens
  chr2:237081277-237081395
  hyper
ctgaaggctgggaaacgtgacccttcacacctgcgccgccctctccactccagcgacgaggaacaggaggagccacagccgctcggcccgcgaggcgagccctcgtggcatctgggaa

SEQ ID NO: 6725 - DNA, 377 bp, Homo sapiens; identical to SEQ ID NO: 285
  chr2:237082343-237082720
  hyper

SEQ ID NO: 6726 - DNA, 37 bp, Homo sapiens
  chr2:237086438-237086475
  hyper
accgagacggaggtgcggaggccgtgtctggccctgg

SEQ ID NO: 6727 - DNA, 177 bp, Homo sapiens
  chr2:237086712-237086889
  hyper
cagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggcc

SEQ ID NO: 6728 - DNA, 22 bp, Homo sapiens
  chr2:237145988-237146010
  hyper
ggccggggcgcggggcgggggc

SEQ ID NO: 6729 - DNA, 50 bp, Homo sapiens
  chr2:237146264-237146314
  hyper
gtggggggaggcgggcgtctggtctcggggcggggcggacgccgcgggcc

SEQ ID NO: 6730 - DNA, 202 bp, Homo sapiens; identical to SEQ ID NO: 2192
  chr2:237416164-237416366
  hyper

SEQ ID NO: 6731 - DNA, 117 bp, Homo sapiens
  chr2:238395216-238395333
  hyper
cggtcctggaaccaccgcgccgcgcgtcctggcttccacatctgccccatttgcccgcggatcttgactttttcttggcgggcaaggcctcggtctcctccccgcagcagggctgcc

SEQ ID NO: 6732 - DNA, 420 bp, Homo sapiens
  chr2:238536266-238536686
  hyper
cagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgg

SEQ ID NO: 6733 - DNA, 43 bp, Homo sapiens; identical to SEQ ID NO: 2193
  chr2:238864588-238864631
  hyper

SEQ ID NO: 6734 - DNA, 330 bp, Homo sapiens; identical to SEQ ID NO: 2194
  chr2:238864726-238865056
  hyper

SEQ ID NO: 6735 - DNA, 30 bp, Homo sapiens
  chr2:238865269-238865299
  hyper
cagatgagggggctgcgtccacccccaccc

SEQ ID NO: 6736 - DNA, 62 bp, Homo sapiens
  chr2:239072210-239072272
  hyper
aggacgcaaagactccgaggcccttcaggccgaggggacgtcgccctcgccccacccctgcg

SEQ ID NO: 6737 - DNA, 111 bp, Homo sapiens; identical to SEQ ID NO: 2195
  chr2:239140138-239140249
  hyper

SEQ ID NO: 6738 - DNA, 30 bp, Homo sapiens
  chr2:239755137-239755167
  hyper
gggtggggctgggtgcggtggctctgcaga

SEQ ID NO: 6739 - DNA, 40 bp, Homo sapiens
  chr2:239757929-239757969
  hyper
ggcctgcccagtgggcgtagaggtgcgggcctgcggctcc

SEQ ID NO: 6740 - DNA, 30 bp, Homo sapiens
  chr2:239758179-239758209
  hyper
tgaccctggagtacccgggaggggccccgc

SEQ ID NO: 6741 - DNA, 37 bp, Homo sapiens
  chr2:239758409-239758446
  hyper
ccctttagacaagctcgagccacggaggcgccgtcct

SEQ ID NO: 6742 - DNA, 187 bp, Homo sapiens; identical to SEQ ID NO: 286
  chr2:241393223-241393410
  hyper

SEQ ID NO: 6743 - DNA, 301 bp, Homo sapiens; identical to SEQ ID NO: 2197
  chr2:241758377-241758678
  hyper

SEQ ID NO: 6744 - DNA, 483 bp, Homo sapiens
  chr2:241759211-241759694
  hyper
ccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctc

SEQ ID NO: 6745 - DNA, 42 bp, Homo sapiens
  chr2:241760366-241760408
  hyper
aagtcacacgccgctcgggggccaccccggcaaaccccagcc

SEQ ID NO: 6746 - DNA, 30 bp, Homo sapiens
  chr2:241760679-241760709
  hyper
cccagcaggggcctgcgctgccctagcggc

SEQ ID NO: 6747 - DNA, 101 bp, Homo sapiens
  chr2:241771227-241771328
  hyper
cgccacggtccccctcgggcctgggaagcctggaaggtcagggcctggaggggagctgggtccaggcagggaactcacagcagagacgccccgagggtggg

SEQ ID NO: 6748 - DNA, 30 bp, Homo sapiens
  chr2:241771696-241771726
  hyper
tccccgcccctgccccgctgtaggccccgc

SEQ ID NO: 6749 - DNA, 458 bp, Homo sapiens
  chr3:238258-238716
  hyper
gcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgc

SEQ ID NO: 6750 - DNA, 103 bp, Homo sapiens
  chr3:239006-239109
  hyper
gggcgcccgaatccgccgggtcccactcacgcccgccggccgccggtaggttggccctcccgcttccagcctccgccaccccatccctcgctgctctctgagg

SEQ ID NO: 6751 - DNA, 522 bp, Homo sapiens; identical to SEQ ID NO: 287
  chr3:239347-239869
  hyper

SEQ ID NO: 6752 - DNA, 59 bp, Homo sapiens
  chr3:240193-240252
  hyper
ctaggcatttaactacgtgcctcagtttccctttctcaataatacggagattatcgata

SEQ ID NO: 6753 - DNA, 32 bp, Homo sapiens
  chr3:2139944-2139976
  hyper
aagttcaatgccacccgcccacccacattccc

SEQ ID NO: 6754 - DNA, 103 bp, Homo sapiens
  chr3:2140332-2140435
  hyper
cgcgcactgagcatgcgcgggctccgggcctccggcgcgtctccccgtccccgctcgtctcccgcccgttcccacccgcccgcgcctctccccttccccgagc

SEQ ID NO: 6755 - DNA, 36 bp, Homo sapiens
  chr3:2140827-2140863
  hyper
ggggccgtccagctcagagcccggaagccctgcagg

SEQ ID NO: 6756 - DNA, 81 bp, Homo sapiens; identical to SEQ ID NO: 2199
  chr3:3840498-3840579
  hyper

SEQ ID NO: 6757 - DNA, 69 bp, Homo sapiens
  chr3:3840887-3840956
  hyper
cccctagacaaaaagcggcgaccgcggcccggccacccgagccccgccgcgctgcgcctttgttgggcg

SEQ ID NO: 6758 - DNA, 148 bp, Homo sapiens
  chr3:3841494-3841642
  hyper
cctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgg

SEQ ID NO: 6759 - DNA, 422 bp, Homo sapiens
  chr3:3842186-3842608
  hyper
ttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgt

SEQ ID NO: 6760 - DNA, 196 bp, Homo sapiens
  chr3:4910354-4910550
  hyper
gcttcgccgcgtgcgcgtgcgcatggtggggtttggctggctgcgggatgcggtcgaggccgccgaggccgcaaactccagtgggaaggcggcgtgccgcggccggcttcggtggaggagggggcgtttccccggaaaaggaaggaagtgggtgtcacgggcctcaatacggcccctttgacgtcttgagtgggaa

SEQ ID NO: 6761 - DNA, 30 bp, Homo sapiens
  chr3:5019001-5019031
  hyper
gggagctctccaaggcgacctgaaggaaat

SEQ ID NO: 6762 - DNA, 82 bp, Homo sapiens
  chr3:5137937-5138019
  hyper
gggtggggggtggtgcggggagtcacatgcgtcccctccgaagctgggctggagttcatttacagctcgcttttctaggcct

SEQ ID NO: 6763 - DNA, 278 bp, Homo sapiens
  chr3:6902321-6902599
  hyper
tagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctcccc

SEQ ID NO: 6764 - DNA, 15 bp, Homo sapiens
  chr3:6903084-6903099
  hyper
ctgaggaagctgctc

SEQ ID NO: 6765 - DNA, 47 bp, Homo sapiens
  chr3:6904160-6904207
  hyper
cctgtagccagcctccgcgagagcccagggcgcgaggtgctgggacc

SEQ ID NO: 6766 - DNA, 306 bp, Homo sapiens
  chr3:8809409-8809715
  hyper
aggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagc

SEQ ID NO: 6767 - DNA, 30 bp, Homo sapiens
  chr3:8810241-8810271
  hyper
agcgtgccagttcctcgggatgttcagcgg

SEQ ID NO: 6768 - DNA, 68 bp, Homo sapiens
  chr3:8811111-8811179
  hyper
gatgggtacaggaggcgagcgaggagcgcctcccaggctgcgcgcgcggacagcgtctggatgcggcg

SEQ ID NO: 6769 - DNA, 258 bp, Homo sapiens
  chr3:9541746-9542004
  hyper
ttctctgtgcctgtgcgtccccctcgctccttctccaatcatctctcatctccctgtctctgcacccctcttctcctcaccccagtgtcttctcccattcccagtcgcttgctgcgcccctcccctcactctctcctaactctgctctccccctccaacgctgggcttggtttgcatctttgaggaactccctcctaccccaactccctcccacggggctcccgcatcctcccgcatttaactcggaccctctgtccc

SEQ ID NO: 6770 - DNA, 57 bp, Homo sapiens
  chr3:9593979-9594036
  hyper
gcagatcttgtagaccgtagccgtgttgcagaagaagaaaagcgaaaagcaggtgat

SEQ ID NO: 6771 - DNA, 47 bp, Homo sapiens; identical to SEQ ID NO: 2200
  chr3:9595395-9595442
  hyper

SEQ ID NO: 6772 - DNA, 41 bp, Homo sapiens
  chr3:9745437-9745478
  hyper
gctgctccaatggggcgggggccgcccgcagggccgggcgg

SEQ ID NO: 6773 - DNA, 334 bp, Homo sapiens; identical to SEQ ID NO: 2201
  chr3:9904291-9904625
  hyper

SEQ ID NO: 6774 - DNA, 703 bp, Homo sapiens
  chr3:9956910-9957613
  hyper
tcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaag

SEQ ID NO: 6775 - DNA, 35 bp, Homo sapiens
  chr3:9993993-9994028
  hyper
ccagctcctcacctgcgcgccgcagcccccgtgtt

SEQ ID NO: 6776 - DNA, 55 bp, Homo sapiens
  chr3:10207053-10207108
  hyper
acagcctgcaaagtgcgagcctcgaccctgtagggacccacggtgctgtcacttc

SEQ ID NO: 6777 - DNA, 112 bp, Homo sapiens
  chr3:10749325-10749437
  hyper
cccccttccctcacccgcaggcgccgggtccgcggacgcccaccccggcccgccccgcccgccgcctggtgcccgctcaaggtcactgctgacaaggcgcctgcctccgcgg

SEQ ID NO: 6778 - DNA, 267 bp, Homo sapiens
  chr3:10749637-10749904
  hyper
tgccgccgccgctgccgctggtgcgcgcccggcccggcccggccccgctgcggctgcggctcctctgccgcggctgccccgcgctcgcctgccccgcggccccgccgccgcccgcccgcctccctccctccgccgccgcctctgccaccgctgcactgcgctctgcccgcctccccctcccgccctccctgctcactcctccccgcgcgctccccctcggccctccccaaactcctcacggagagcgccccgcgggaccggagcgcg

SEQ ID NO: 6779 - DNA, 43 bp, Homo sapiens
  chr3:10857674-10857717
  hyper
cagtgggcagggccgcgggaaggacgggcgctgcaggggctcc

SEQ ID NO: 6780 - DNA, 50 bp, Homo sapiens
  chr3:11034716-11034766
  hyper
ggggggcggacacctcgagattcaagcccccgcgccgcaccttccctgag

SEQ ID NO: 6781 - DNA, 182 bp, Homo sapiens; identical to SEQ ID NO: 288
  chr3:11035171-11035353
  hyper

SEQ ID NO: 6782 - DNA, 6 bp, Homo sapiens
  chr3:11035382-11035388
  hyper
cgggca

SEQ ID NO: 6783 - DNA, 144 bp, Homo sapiens
  chr3:12046209-12046353
  hyper
cgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtgga

SEQ ID NO: 6784 - DNA, 60 bp, Homo sapiens
  chr3:12046377-12046437
  hyper
cgccaggaaggccaaggtgctgctggtggtcgacgagccgcacgccgactggtaggtgcc

SEQ ID NO: 6785 - DNA, 30 bp, Homo sapiens
  chr3:12917639-12917669
  hyper
gcgtgggggcagcagcgtctggagggaggt

SEQ ID NO: 6786 - DNA, 535 bp, Homo sapiens; identical to SEQ ID NO: 2204
  chr3:13323494-13324029
  hyper

SEQ ID NO: 6787 - DNA, 114 bp, Homo sapiens; identical to SEQ ID NO: 2205
  chr3:13324234-13324348
  hyper

SEQ ID NO: 6788 - DNA, 19 bp, Homo sapiens
  chr3:13324419-13324438
  hyper
gatccgggtcagctcctgc

SEQ ID NO: 6789 - DNA, 29 bp, Homo sapiens
  chr3:13324645-13324674
  hyper
gcctcctgctccccgcgccgccgcgctcc

SEQ ID NO: 6790 - DNA, 186 bp, Homo sapiens
  chr3:13324740-13324926
  hyper
gaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcgg

SEQ ID NO: 6791 - DNA, 194 bp, Homo sapiens; identical to SEQ ID NO: 290
  chr3:13590447-13590641
  hyper

SEQ ID NO: 6792 - DNA, 48 bp, Homo sapiens; identical to SEQ ID NO: 291
  chr3:13590973-13591021
  hyper

SEQ ID NO: 6793 - DNA, 57 bp, Homo sapiens
  chr3:13920328-13920385
  hyper
gctccgagcctcacacgcgttgtcttaagtacaaagggtgaccggctttgcacaagc

SEQ ID NO: 6794 - DNA, 58 bp, Homo sapiens
  chr3:13921080-13921138
  hyper
cggggggcctttgtgcgtccaccgctcccacaccgcacccacccggcctctcagagaa

SEQ ID NO: 6795 - DNA, 131 bp, Homo sapiens
  chr3:13921475-13921606
  hyper
ggagcacgggagccacggagcgggaggagggagggaggagcgagcgcggcgtggggcgacgccgggctgcgcgcgagcgaccggtgcaagtgtgcgagacgcggggagtgcgggggcgctgctgcctccag

SEQ ID NO: 6796 - DNA, 278 bp, Homo sapiens
  chr3:14643752-14644030
  hyper
gtcagacaacaggtacgcggggagcagcccgggcggccccgcgcaggggttgagccgcagcgctgctgtgcaggggcaggcccgggcagggggcagtgcggcgagtcagccccctccctggcctcctcgcaactttgagtaaccgcggactccggggtcggcatgggggtggcgccgggcgttcaaaggaaagttgggtgcgacggaccgcagcctcgggggccaaaggacccccaccgtgagcgcggccacctcccgacacccggcgggctggctgg

SEQ ID NO: 6797 - DNA, 95 bp, Homo sapiens
  chr3:14851832-14851927
  hyper
tgagttctcgtccttcgaacccccagcgcctcccgcggtgcccatggccacggcccctttaaatgtgcgcagggacgccccggccctcgcctccc

SEQ ID NO: 6798 - DNA, 59 bp, Homo sapiens
  chr3:14852367-14852426
  hyper
agcaggtaggaggcccggcgacctccggcgccgaggcacgagcgcgagggaccccggcc

SEQ ID NO: 6799 - DNA, 59 bp, Homo sapiens
  chr3:16554052-16554111
  hyper
acagacagcagggagcgtgcctggttctacaaccttggcctccacgcggttcttgctgc

SEQ ID NO: 6800 - DNA, 119 bp, Homo sapiens; identical to SEQ ID NO: 2209
  chr3:16554347-16554466
  hyper

SEQ ID NO: 6801 - DNA, 189 bp, Homo sapiens; identical to SEQ ID NO: 2210
  chr3:16554467-16554656
  hyper

SEQ ID NO: 6802 - DNA, 466 bp, Homo sapiens
  chr3:18485186-18485652
  hyper
aaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctc

SEQ ID NO: 6803 - DNA, 76 bp, Homo sapiens
  chr3:19189419-19189495
  hyper
gcctcacaactaactcgggctgccctgcccctgtcgcgtgggctcgcaatggcaagtgctccggaagggggccgcc

SEQ ID NO: 6804 - DNA, 56 bp, Homo sapiens
  chr3:19190075-19190131
  hyper
cctgctcggccccgccgtcaggccgggtcccccttccctgccgtcatcaggttccc

SEQ ID NO: 6805 - DNA, 15 bp, Homo sapiens
  chr3:22413896-22413911
  hyper
ctccgccacctgaac

SEQ ID NO: 6806 - DNA, 119 bp, Homo sapiens
  chr3:22413959-22414078
  hyper
cggcgcccccaggagcttttctctccttcctcccaccgagctcttcattctcctgctggcggccgcccggcgccctggccctggcatccgggaggagcagccgccggggctggctgtcc

SEQ ID NO: 6807 - DNA, 75 bp, Homo sapiens
  chr3:24870769-24870844
  hyper
cctggcgccagggggcggggcgcagcgagccgggctcccgctgtctgctctcagcggcggcggcaggggctgagg

SEQ ID NO: 6808 - DNA, 32 bp, Homo sapiens
  chr3:24872010-24872042
  hyper
ccttccagctctcagcgcggggtgagtttccc

SEQ ID NO: 6809 - DNA, 45 bp, Homo sapiens; identical to SEQ ID NO: 2211
  chr3:26665077-26665122
  hyper

SEQ ID NO: 6810 - DNA, 63 bp, Homo sapiens
  chr3:26665569-26665632
  hyper
ctgggtacctgggggcgcgtggagacaaggaatggagccccggaatgccgggcccttgggtac

SEQ ID NO: 6811 - DNA, 47 bp, Homo sapiens
  chr3:27754174-27754221
  hyper
gtggatgtgtgtgtgcgcactcgcccacgtctcgtgttttacttttc

SEQ ID NO: 6812 - DNA, 67 bp, Homo sapiens
  chr3:27754465-27754532
  hyper
attcttttcaagacacgcgccggtggaccgggtcctgggattggcttactcccgggctggaccttgg

SEQ ID NO: 6813 - DNA, 114 bp, Homo sapiens
  chr3:27754814-27754928
  hyper
aaatcaaagggaatgcggggaagtttttattccagagcgtttccatgacacccgcagagatttaaaaaattacattcctccccctacgcaggtttaattcggaaagaagagact

SEQ ID NO: 6814 - DNA, 66 bp, Homo sapiens
  chr3:27756087-27756153
  hyper
ggggtgtggggaaggcgctgaccaggataggggggctatgagtctcccttccggaatctaaatcag

SEQ ID NO: 6815 - DNA, 985 bp, Homo sapiens
  chr3:27762857-27763842
  hyper
gtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattat

SEQ ID NO: 6816 - DNA, 32 bp, Homo sapiens
  chr3:27764130-27764162
  hyper
atccacccactagcccgcgcctttctgccctt

SEQ ID NO: 6817 - DNA, 15 bp, Homo sapiens
  chr3:27764457-27764472
  hyper
ttggggtctccatag

SEQ ID NO: 6818 - DNA, 181 bp, Homo sapiens; identical to SEQ ID NO: 2212
  chr3:27765181-27765362
  hyper

SEQ ID NO: 6819 - DNA, 507 bp, Homo sapiens
  chr3:27771497-27772004
  hyper
cctcctgcatgaaagcgcgctctaaagctagggtttttggactttaggagcgcttctcgcctccccctagacgtttgaagccttccaattgagcaagggctgggaagcgagaaggctcctctggtctctccctcctctgagcgcgggacctcggcggacaccctaatcccgaaacactcctctctgggactgcgcacttgccagcacgacagccaactccgcctcagaggagtcttttagggctctgagcgagtggcgaatgctcccccggtgatgcactatcgctcccacccacgccctggtacgcgcagcccgggaaaaagaaaaaaaaaagtccacgtaggggctcaaacccaggcgtcaggcgctgcagtcagggaaggctcccttaggggctgggttcctggcgcttacgacgcagagaaggataagggcgatggtttcgcaatcccaccccctcctttgtcctcctccccacctcccagcctttggcggcttagatctcca

SEQ ID NO: 6820 - DNA, 367 bp, Homo sapiens; identical to SEQ ID NO: 2213
  chr3:28616764-28617131
  hyper

SEQ ID NO: 6821 - DNA, 306 bp, Homo sapiens; identical to SEQ ID NO: 2214
  chr3:28617343-28617649
  hyper

SEQ ID NO: 6822 - DNA, 45 bp, Homo sapiens
  chr3:28617899-28617944
  hyper
tcaggatgaactgcccggcgagagtgcaggcgctgaggacagcga

SEQ ID NO: 6823 - DNA, 40 bp, Homo sapiens
  chr3:32857752-32857792
  hyper
aaggtgggtaaaaaccgagatctcccgggcagtggatatg

SEQ ID NO: 6824 - DNA, 33 bp, Homo sapiens
  chr3:32858114-32858147
  hyper
atcagtcccaataaccggcgtactgaagagaag

SEQ ID NO: 6825 - DNA, 606 bp, Homo sapiens; identical to SEQ ID NO: 292
  chr3:32858353-32858959
  hyper

SEQ ID NO: 6826 - DNA, 30 bp, Homo sapiens; identical to SEQ ID NO: 293
  chr3:32859255-32859285
  hyper

SEQ ID NO: 6827 - DNA, 800 bp, Homo sapiens; identical to SEQ ID NO: 294
  chr3:32859417-32860217
  hyper

SEQ ID NO: 6828 - DNA, 57 bp, Homo sapiens
  chr3:33259719-33259776
  hyper
cccactcatctttcacgtcttcccggaccaagccaaaatatccgagggagttttcta

SEQ ID NO: 6829 - DNA, 770 bp, Homo sapiens; identical to SEQ ID NO: 2218
  chr3:33260026-33260796
  hyper

SEQ ID NO: 6830 - DNA, 131 bp, Homo sapiens
  chr3:35680984-35681115
  hyper
ccgcgtgggagggcacggaccggcggaggggcagacgacggaggcggccaagctggaggaacgggaccgagggatcgaccgaggctggctggctaggggtgggactggcagagctacggacaggtgggagc

SEQ ID NO: 6831 - DNA, 59 bp, Homo sapiens
  chr3:35681483-35681542
  hyper
agagcagacaggaggcgggggcgcgttcactcccggcggccagccggccagagaaggcg

SEQ ID NO: 6832 - DNA, 149 bp, Homo sapiens
  chr3:36805921-36806070
  hyper
gcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttg

SEQ ID NO: 6833 - DNA, 240 bp, Homo sapiens; identical to SEQ ID NO: 2219
  chr3:38035773-38036013
  hyper

SEQ ID NO: 6834 - DNA, 32 bp, Homo sapiens
  chr3:38071358-38071390
  hyper
ccgccacccacgggccgcgggccctgtcatta

SEQ ID NO: 6835 - DNA, 286 bp, Homo sapiens
  chr3:38080723-38081009
  hyper
ccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccgg

SEQ ID NO: 6836 - DNA, 133 bp, Homo sapiens
  chr3:38081153-38081286
  hyper
cggacggtgccggggtctcagcgctcggcacgcgtcagcacctgccaggtgccaggcgctgttccaggatctggggctgcagttgagaaacagcccatcatgccgaagtgggcccgacattctagtggaagga

SEQ ID NO: 6837 - DNA, 76 bp, Homo sapiens
  chr3:38690624-38690700
  hyper
tgaccttggggtctccggcctccggtatccgggtcccaatcccagaccctccccgagcctgcgccagggatggccg

SEQ ID NO: 6838 - DNA, 66 bp, Homo sapiens
  chr3:42543514-42543580
  hyper
gagtcgggcctctttcgagccctcgcttcctctcgcctggcttcttcggcgcgaaggatgaattgg

SEQ ID NO: 6839 - DNA, 672 bp, Homo sapiens
  chr3:42814446-42815118
  hyper
tgcatggaaaataagcgtctgcctgggttagaagagggctgtgtgtgaagattcaaaggacgaaggggaagagtcctcgctgggcgcccagcacgcggtgagcgcccggccagtggcagcgcgctcgggctggggttgcgctcgggctcggttccgcgcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 6840 - DNA, 30 bp, Homo sapiens
  chr3:42947411-42947441
  hyper
ccacctagggtgcagcgagctggagaggaa

SEQ ID NO: 6841 - DNA, 65 bp, Homo sapiens
  chr3:43020926-43020991
  hyper
tgtgcagcgatctcccgagagttggcgcagggccacttggctgcagagaacgtgtgcaccttcag

SEQ ID NO: 6842 - DNA, 111 bp, Homo sapiens
  chr3:43021302-43021413
  hyper
caccagagctgggggcgatcggctttcctgccgctcttagtggggcggaccgtaataagggggcttttattactaatctgcactccttgacctaaccgtaacccactcgca

SEQ ID NO: 6843 - DNA, 272 bp, Homo sapiens
  chr3:43935870-43936142
  hyper
cagcgcgctcccaaccgctggagacagaaacaatgtgcgcgcgcacacggcccacgtgcacgcgcgcacgcccacgcggcatacaggcgcgcacgtgcacacgcgcgcctgcacagctctgcggctctgctccggccccacaggcccatcttaaagtgtttcgtgctctaacttaccaaacacgtggcagccggcagaacgaaaaggaaaataaatgaactgcgacgaaataaagcaggcctttccgcagtcggccacgtccaacagccact

SEQ ID NO: 6844 - DNA, 854 bp, Homo sapiens; identical to SEQ ID NO: 2220
  chr3:44036274-44037128
  hyper

SEQ ID NO: 6845 - DNA, 1765 bp, Homo sapiens; identical to SEQ ID NO: 2221
  chr3:44037129-44038894
  hyper

SEQ ID NO: 6846 - DNA, 602 bp, Homo sapiens; identical to SEQ ID NO: 2222
  chr3:44039424-44040026
  hyper

SEQ ID NO: 6847 - DNA, 1039 bp, Homo sapiens; identical to SEQ ID NO: 2223
  chr3:44040056-44041095
  hyper

SEQ ID NO: 6848 - DNA, 321 bp, Homo sapiens; identical to SEQ ID NO: 295
  chr3:44063500-44063821
  hyper

SEQ ID NO: 6849 - DNA, 555 bp, Homo sapiens
  chr3:44596464-44597019
  hyper
ggtgtagagctgggacgcgtctggatcccccgactatggcctgagagcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgc

SEQ ID NO: 6850 - DNA, 87 bp, Homo sapiens; identical to SEQ ID NO: 2225
  chr3:44626451-44626538
  hyper

SEQ ID NO: 6851 - DNA, 13 bp, Homo sapiens
  chr3:44626539-44626552
  hyper
ggttctgggagcg

SEQ ID NO: 6852 - DNA, 24 bp, Homo sapiens
  chr3:44726825-44726849
  hyper
atctgcatgcgattaaaaatgggt

SEQ ID NO: 6853 - DNA, 16 bp, Homo sapiens
  chr3:44727053-44727069
  hyper
aggctacggggcgccc

SEQ ID NO: 6854 - DNA, 19 bp, Homo sapiens
  chr3:44727070-44727089
  hyper
gccccgcacacccaagaaa

SEQ ID NO: 6855 - DNA, 66 bp, Homo sapiens
  chr3:44771010-44771076
  hyper
gcgggaaggaaccaccgagcggaagccgctcccaccttcctagagaggagacggtagtggttatta

SEQ ID NO: 6856 - DNA, 118 bp, Homo sapiens
  chr3:45837583-45837701
  hyper
gagggcttgggagggcggcttgggagagagctccggctccggaacgaggtgtcctgggaacactcccgggtctgtaacttcggacaaatcacgctcgctttcccggcctcagtgtgcc

SEQ ID NO: 6857 - DNA, 265 bp, Homo sapiens
  chr3:45837907-45838172
  hyper
ccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagagga

SEQ ID NO: 6858 - DNA, 409 bp, Homo sapiens; identical to SEQ ID NO: 296
  chr3:48693292-48693701
  hyper

SEQ ID NO: 6859 - DNA, 31 bp, Homo sapiens; identical to SEQ ID NO: 297
  chr3:48693851-48693882
  hyper

SEQ ID NO: 6860 - DNA, 272 bp, Homo sapiens; identical to SEQ ID NO: 298
  chr3:48693883-48694155
  hyper

SEQ ID NO: 6861 - DNA, 164 bp, Homo sapiens; identical to SEQ ID NO: 299
  chr3:48698847-48699011
  hyper

SEQ ID NO: 6862 - DNA, 363 bp, Homo sapiens; identical to SEQ ID NO: 300
  chr3:48699376-48699739
  hyper

SEQ ID NO: 6863 - DNA, 30 bp, Homo sapiens
  chr3:48699943-48699973
  hyper
agccctggtgcccaccgccccccagctcct

SEQ ID NO: 6864 - DNA, 30 bp, Homo sapiens
  chr3:48700359-48700389
  hyper
ccggcgcccgaaacacggtggtacaaccca

SEQ ID NO: 6865 - DNA, 41 bp, Homo sapiens
  chr3:49851326-49851367
  hyper
ggaaccaaggccaagcgaataagggacgctgctggtcacag

SEQ ID NO: 6866 - DNA, 78 bp, Homo sapiens
  chr3:49907209-49907287
  hyper
cagggaggaagtgatcgcgggctcagcggggcgccgagggctccggggacggcgggcagaatccgctccgagcacgcg

SEQ ID NO: 6867 - DNA, 170 bp, Homo sapiens
  chr3:50243350-50243520
  hyper
tgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaacc

SEQ ID NO: 6868 - DNA, 116 bp, Homo sapiens
  chr3:50402170-50402286
  hyper
gcagggagaccaggacgcccagcgacggcgggaaggaggccccgcggccacagtctgaggtatcttcctgcggggagagacaaggagctggtcggcctgggcgggcgcaaggccgc

SEQ ID NO: 6869 - DNA, 156 bp, Homo sapiens
  chr3:50402494-50402650
  hyper
gggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagttt

SEQ ID NO: 6870 - DNA, 269 bp, Homo sapiens
  chr3:54155224-54155493
  hyper
cccaggtgtctggtgcgccgggagccccggcgacgttaggagcgcactccttgctggggtcaccggagttgcgcttggccgggcaaggatgactcagcctcactccggtcggtctttaccgccagcctgcgcgagggctccacaaagttcccaatcacaccccatacctcgcacgggggagaggggttctgcaagctgggtcccggggtgggggcagcggcgagagaggcggggagaagcctggttcccagaacgcgcaggggcttctc

SEQ ID NO: 6871 - DNA, 23 bp, Homo sapiens
  chr3:54155524-54155547
  hyper
cgagaaggcgcctcctccggcgc

SEQ ID NO: 6872 - DNA, 110 bp, Homo sapiens
  chr3:54155775-54155885
  hyper
cgcagggggccgctgcgctgcggccggatgccgggagccccgcgctggtgcgcccaagccgtggtggcagcaccgccctccgtgctttcccctgtcgggcgccgcggccg

SEQ ID NO: 6873 - DNA, 77 bp, Homo sapiens
  chr3:54156663-54156740
  hyper
gcccaccgcccgctccgcgcagctccccgcggccgctctcgtcgccgccgcagcgggcgcgtcggagggagcccagc

SEQ ID NO: 6874 - DNA, 40 bp, Homo sapiens
  chr3:54157034-54157074
  hyper
gctctggcccctgcccgcaggttgccgagtgagatctgga

SEQ ID NO: 6875 - DNA, 358 bp, Homo sapiens
  chr3:54157315-54157673
  hyper
gcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatgg

SEQ ID NO: 6876 - DNA, 146 bp, Homo sapiens
  chr3:55521121-55521267
  hyper
tgcggagtcctccggcgcgcgtccggcgggcgcagtgaaccggagctgaagcgggcactggcgcccgggcctggactcccgagttggggcagagctgggatgcgcccaggaatggagggggcgcggacgcgcgcgagccggcagca

SEQ ID NO: 6877 - DNA, 114 bp, Homo sapiens
  chr3:55522622-55522736
  hyper
tggggtgccgggaggcggggtacactctccttgtctccccttctctaagttccccatcccccgcggcatctgctgaaagagagaggtccactccgcagccgctgcctgcctgcc

SEQ ID NO: 6878 - DNA, 104 bp, Homo sapiens
  chr3:55523009-55523113
  hyper
ttgctcatctggctccggcccagagcatgaggcgcgatgcgtggtcctgccacggagatcttggcgggtgccctcaggtgaggagattgcgaagtttggcaaaa

SEQ ID NO: 6879 - DNA, 50 bp, Homo sapiens
  chr3:56502716-56502766
  hyper
agcgcccggcatgggcgggggtcttcgcagcgcctcctcccggcaggccg

SEQ ID NO: 6880 - DNA, 30 bp, Homo sapiens
  chr3:62305019-62305049
  hyper
tgcattaattggcctcgttgcaaaaggaaa

SEQ ID NO: 6881 - DNA, 443 bp, Homo sapiens; identical to SEQ ID NO: 301
  chr3:62353488-62353931
  hyper

SEQ ID NO: 6882 - DNA, 45 bp, Homo sapiens
  chr3:62354283-62354328
  hyper
caaatagtcgcctcccgccgtggaaatacgcgtggggtcagctcc

SEQ ID NO: 6883 - DNA, 168 bp, Homo sapiens; identical to SEQ ID NO: 2233
  chr3:62354625-62354793
  hyper

SEQ ID NO: 6884 - DNA, 40 bp, Homo sapiens; identical to SEQ ID NO: 2234
  chr3:62354899-62354939
  hyper

SEQ ID NO: 6885 - DNA, 54 bp, Homo sapiens
  chr3:62355424-62355478
  hyper
aaagatggctaggggcgccgcgctcttctggggcgctcacggtgacaggctggg

SEQ ID NO: 6886 - DNA, 446 bp, Homo sapiens; identical to SEQ ID NO: 302
  chr3:62355774-62356220
  hyper

SEQ ID NO: 6887 - DNA, 279 bp, Homo sapiens; identical to SEQ ID NO: 303
  chr3:62356366-62356645
  hyper

SEQ ID NO: 6888 - DNA, 367 bp, Homo sapiens; identical to SEQ ID NO: 304
  chr3:62356792-62357159
  hyper

SEQ ID NO: 6889 - DNA, 176 bp, Homo sapiens
  chr3:62357495-62357671
  hyper
ccaatactgtgtggccgctgacaagggcatccccattttacagaataggaaactgaggcccaacgaggctcccagtttgggtagtcaactactggggagctcctcagcttgaaaaaggggcattccaggctgccccaaggaagccgccgccgccgatcgcccctcccggcccccct

SEQ ID NO: 6890 - DNA, 15 bp, Homo sapiens
  chr3:62357735-62357750
  hyper
cggagcctcctggca

SEQ ID NO: 6891 - DNA, 239 bp, Homo sapiens
  chr3:62358336-62358575
  hyper
cggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaagccgagcttgccatggcgcgcggagctgagccgagccaggctgggc

SEQ ID NO: 6892 - DNA, 30 bp, Homo sapiens
  chr3:62358873-62358903
  hyper
cgggcctctgccacgcgtgctgggagctgg

SEQ ID NO: 6893 - DNA, 1051 bp, Homo sapiens; identical to SEQ ID NO: 305
  chr3:62359440-62360491
  hyper

SEQ ID NO: 6894 - DNA, 66 bp, Homo sapiens
  chr3:62362851-62362917
  hyper
gcctcagcctagagccggacgctttggcttcttcgccatctggccctaggttgggcctcaaactcc

SEQ ID NO: 6895 - DNA, 581 bp, Homo sapiens; identical to SEQ ID NO: 2239
  chr3:62363596-62364177
  hyper

SEQ ID NO: 6896 - DNA, 373 bp, Homo sapiens; identical to SEQ ID NO: 2240
  chr3:62364753-62365126
  hyper

SEQ ID NO: 6897 - DNA, 54 bp, Homo sapiens
  chr3:62861840-62861894
  hyper
taatgcgtcgactgtcgcactctgttcacccctgcctctcgggtaaactattaa

SEQ ID NO: 6898 - DNA, 200 bp, Homo sapiens
  chr3:63264640-63264840
  hyper
ggcttagacaagtgtcgtctcacctcaccgcttgcagacgcgcaggggctgtggaaagaaacctcccccttgggagataggggaggggggcgcatggaagggctgccgctgggttctggcccctcacctggaccttcgtggggatgaggggatgggtggagggacccatagttgagcggaggagccgggaagacttggcc

SEQ ID NO: 6899 - DNA, 30 bp, Homo sapiens
  chr3:64672193-64672223
  hyper
aagcgggcgaggaggcggaaggggagagga

SEQ ID NO: 6900 - DNA, 94 bp, Homo sapiens
  chr3:68057086-68057180
  hyper
agcccagggtcctcccgcgcgcctgcaccaggctgcagcgagcgcgcaagcctgctgggtgctggagctcgggccgccccgggagaaggggtgg

SEQ ID NO: 6901 - DNA, 31 bp, Homo sapiens; identical to SEQ ID NO: 306
  chr3:68980916-68980947
  hyper

SEQ ID NO: 6902 - DNA, 270 bp, Homo sapiens; identical to SEQ ID NO: 307
  chr3:68980948-68981218
  hyper

SEQ ID NO: 6903 - DNA, 398 bp, Homo sapiens
  chr3:69435163-69435561
  hyper
gggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggc

SEQ ID NO: 6904 - DNA, 37 bp, Homo sapiens
  chr3:69435621-69435658
  hyper
cgagtggtctcctaatctgcctcggggaacaccttac

SEQ ID NO: 6905 - DNA, 30 bp, Homo sapiens
  chr3:69590888-69590918
  hyper
aaaagggcagccaaacgaaacccttagtgt

SEQ ID NO: 6906 - DNA, 44 bp, Homo sapiens
  chr3:69591371-69591415
  hyper
ctccctgcggcgctccggggctgtagacggctactttattgtct

SEQ ID NO: 6907 - DNA, 65 bp, Homo sapiens
  chr3:69591913-69591978
  hyper
cgccgcacggggctgcgggctgggctagccttccccggcagagaaagggcgccggtgccaggagg

SEQ ID NO: 6908 - DNA, 70 bp, Homo sapiens
  chr3:71179297-71179367
  hyper
aaaaagaaggcaacacgaaacaatgtcacagtaagcagagagaggttccaatctacgtttagcctataaa

SEQ ID NO: 6909 - DNA, 514 bp, Homo sapiens
  chr3:71802858-71803372
  hyper
agagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgc

SEQ ID NO: 6910 - DNA, 130 bp, Homo sapiens
  chr3:71803654-71803784
  hyper
tggccgcggccttcccgccagtgctggacggcggtggcgacgacgaggacgcgccgtgcgccctggagcagcggcccgacggcgcccccggcgcgctgggcttcctgctgctgctggccgtggtggtggg

SEQ ID NO: 6911 - DNA, 119 bp, Homo sapiens
  chr3:71803826-71803945
  hyper
cgaccgccgcaagatgcggcccgcgcgcctggtgcccgccgtcagccacgactggaccttccacggcccgggcgccaccggccaggcggccgccaactggacggcgggcttcggccgcg

SEQ ID NO: 6912 - DNA, 469 bp, Homo sapiens
  chr3:71834256-71834725
  hyper
gtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacata

SEQ ID NO: 6913 - DNA, 15 bp, Homo sapiens
  chr3:75955872-75955887
  hyper
cgctgcgccaccacc

SEQ ID NO: 6914 - DNA, 46 bp, Homo sapiens
  chr3:75956103-75956149
  hyper
gactccaggtgagttcggcaaagaggtgaaccgaggggtctcgaac

SEQ ID NO: 6915 - DNA, 32 bp, Homo sapiens
  chr3:77089150-77089182
  hyper
cctcagaggcggcaccgcgggggtgtctgcag

SEQ ID NO: 6916 - DNA, 360 bp, Homo sapiens
  chr3:79815522-79815882
  hyper
gagtagtgggagctccgactcgaggcaggagtgggatgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaac

SEQ ID NO: 6917 - DNA, 76 bp, Homo sapiens
  chr3:79816876-79816952
  hyper
ccttgcaaccatttccgagacttacccttccataagactgttttcagcaatctagaggctccgtagtgcagacgca

SEQ ID NO: 6918 - DNA, 103 bp, Homo sapiens
  chr3:85007801-85007904
  hyper
aaccccgccccctcgcggtggcgattggctgaacccttcctgagtgcaaagcgctgattaatgaaggcagttgtctcgcctgcaagttcgggcgagacatctc

SEQ ID NO: 6919 - DNA, 118 bp, Homo sapiens; identical to SEQ ID NO: 2243
  chr3:85008597-85008715
  hyper

SEQ ID NO: 6920 - DNA, 30 bp, Homo sapiens
  chr3:85009273-85009303
  hyper
caccatcatcatatccgtgtgtctttaaaa

SEQ ID NO: 6921 - DNA, 30 bp, Homo sapiens
  chr3:85009835-85009865
  hyper
actgggtttggatgccggatggctaaggaa

SEQ ID NO: 6922 - DNA, 30 bp, Homo sapiens
  chr3:87040188-87040218
  hyper
accgcgtccggctcccgcgagggctgcggc

SEQ ID NO: 6923 - DNA, 30 bp, Homo sapiens
  chr3:87841652-87841682
  hyper
agaggagggaggagacggaggagagaagag

SEQ ID NO: 6924 - DNA, 36 bp, Homo sapiens
  chr3:87842210-87842246
  hyper
tctgctccctgggggcgaagttctgtggtgctaggc

SEQ ID NO: 6925 - DNA, 13 bp, Homo sapiens
  chr3:87842247-87842260
  hyper
gagatagtggtca

SEQ ID NO: 6926 - DNA, 75 bp, Homo sapiens
  chr3:96532177-96532252
  hyper
gcggcatccgagccgcggctgccaggccgggagaaggctgggcttggccgggctctgcagcgctccgggctccgt

SEQ ID NO: 6927 - DNA, 105 bp, Homo sapiens
  chr3:96532833-96532938
  hyper
ccgctgagctgtccccggacgggagcgcctgtccacggcactcaccccctccagcggtggaaatgtggagaagtaagtgggaggcggtgtcgggaactgactcct

SEQ ID NO: 6928 - DNA, 224 bp, Homo sapiens
  chr3:96533242-96533466
  hyper
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtg

SEQ ID NO: 6929 - DNA, 205 bp, Homo sapiens
  chr3:98452166-98452371
  hyper
aggagccgtgggggccgagagaatctgctctgggaccctcttttgtcgaatcgccggcgaggttgtgcaattgggaagccaagaggagtgtccagctcctcgttcactattgttttcttgtaaaagggtctgtacgcgaggagggttgaggggtctggaaggttctggtctcttaccgtataaagtttttcgagaaacccttttt

SEQ ID NO: 6930 - DNA, 51 bp, Homo sapiens
  chr3:98620538-98620589
  hyper
cgcagccagctccctcgcgctccctctcgcgcgcgccggccacgcccccta

SEQ ID NO: 6931 - DNA, 234 bp, Homo sapiens
  chr3:99594925-99595159
  hyper
tgcgccggggccgggcgggggccgggccggggccgctgtagtgccgcgctgcgagccgactgtgcgcgctccgagagtcgcccgaacaatgcgagcggggcgctgagcgcgcccggcctatgggcgttacgtcactgttctgccttataaggcgctccgcgtgtgcggcgctgtcggcgggggcgccggtgaccgcgggaccctcggccgcggcggcggcgcagccacacaccc

SEQ ID NO: 6932 - DNA, 30 bp, Homo sapiens
  chr3:110789665-110789695
  hyper
ataaaactacacatacgaacatgcaaagga

SEQ ID NO: 6933 - DNA, 15 bp, Homo sapiens
  chr3:112930422-112930437
  hyper
tccatatggagggac

SEQ ID NO: 6934 - DNA, 30 bp, Homo sapiens
  chr3:112931110-112931140
  hyper
cccgggggctgcagccgctacggggcccag

SEQ ID NO: 6935 - DNA, 30 bp, Homo sapiens
  chr3:115231640-115231670
  hyper
gatggtagaggtgagcgggcgggtgttgaa

SEQ ID NO: 6936 - DNA, 142 bp, Homo sapiens
  chr3:116163769-116163911
  hyper
ctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtg

SEQ ID NO: 6937 - DNA, 16 bp, Homo sapiens
  chr3:117715630-117715646
  hyper
gtcgccaccacctcgc

SEQ ID NO: 6938 - DNA, 358 bp, Homo sapiens; identical to SEQ ID NO: 2245
  chr3:117715766-117716124
  hyper

SEQ ID NO: 6939 - DNA, 99 bp, Homo sapiens; identical to SEQ ID NO: 2246
  chr3:117716213-117716312
  hyper

SEQ ID NO: 6940 - DNA, 368 bp, Homo sapiens; identical to SEQ ID NO: 2247
  chr3:117716313-117716681
  hyper

SEQ ID NO: 6941 - DNA, 48 bp, Homo sapiens
  chr3:120003868-120003916
  hyper
tgctcacctcatcagcgtcggaccgccgagaagcgccaagcccgctgc

SEQ ID NO: 6942 - DNA, 63 bp, Homo sapiens
  chr3:120169776-120169839
  hyper
gcaggacggcggcagcgagctgtaagcggaggtgggagctccgccgatcgccagcctcggagg

SEQ ID NO: 6943 - DNA, 53 bp, Homo sapiens
  chr3:120170117-120170170
  hyper
agggaaaccccaccccgggaggggctgctggctggcggcggcccgggcgggct

SEQ ID NO: 6944 - DNA, 189 bp, Homo sapiens
  chr3:120627329-120627518
  hyper
gagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctga

SEQ ID NO: 6945 - DNA, 39 bp, Homo sapiens; identical to SEQ ID NO: 2248
  chr3:120627972-120628011
  hyper

SEQ ID NO: 6946 - DNA, 173 bp, Homo sapiens; identical to SEQ ID NO: 308
  chr3:121902777-121902950
  hyper

SEQ ID NO: 6947 - DNA, 229 bp, Homo sapiens; identical to SEQ ID NO: 309
  chr3:121902990-121903219
  hyper

SEQ ID NO: 6948 - DNA, 325 bp, Homo sapiens; identical to SEQ ID NO: 310
  chr3:121903323-121903648
  hyper

SEQ ID NO: 6949 - DNA, 45 bp, Homo sapiens
  chr3:122296693-122296738
  hyper
gagtatggtgaggagcgcgggggacgggtgcgggaaggggacagc

SEQ ID NO: 6950 - DNA, 28 bp, Homo sapiens
  chr3:123166978-123167006
  hyper
gccgccgccgccgcccgcagggggcgcc

SEQ ID NO: 6951 - DNA, 430 bp, Homo sapiens; identical to SEQ ID NO: 2253
  chr3:123167300-123167730
  hyper

SEQ ID NO: 6952 - DNA, 102 bp, Homo sapiens
  chr3:123602641-123602743
  hyper
cccgccctaccttcccggaatcacatttgggctggaaggaccttcacgtggcacccccttcccagaggccgtcaccgagtcctctagcgagggtctgggagc

SEQ ID NO: 6953 - DNA, 240 bp, Homo sapiens
  chr3:123603253-123603493
  hyper
gagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgca

SEQ ID NO: 6954 - DNA, 466 bp, Homo sapiens
  chr3:125898741-125899207
  hyper
gaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgc

SEQ ID NO: 6955 - DNA, 184 bp, Homo sapiens
  chr3:125932252-125932436
  hyper
cttttaactttttggcgtggagtgcgcgtcctgacgtgccccctgagctacagcttactgagctttactggcttcgccggacagccgtccccaggtggagagacagcgcgtcgcgcgctgcccgggccccgcagggcctggcgcctggggcccttgcgccgctttggggcgaggggatcacacc

SEQ ID NO: 6956 - DNA, 134 bp, Homo sapiens
  chr3:125986552-125986686
  hyper
gctccatttaccctccgcggagggcgctgtgcggcggcacttaagcggcagcttcctctctcccaggcggcctttgtggctgtggccgggacagggaaaagctgcccaggccaagagggcgggggcgtcagggg

SEQ ID NO: 6957 - DNA, 30 bp, Homo sapiens
  chr3:126113880-126113910
  hyper
gcggcggcaggggtgcgaaaccagggcccg

SEQ ID NO: 6958 - DNA, 34 bp, Homo sapiens
  chr3:126854733-126854767
  hyper
cgcagcccctgcactcgggcggccctgcctcggc

SEQ ID NO: 6959 - DNA, 386 bp, Homo sapiens; identical to SEQ ID NO: 2254
  chr3:127794474-127794860
  hyper

SEQ ID NO: 6960 - DNA, 60 bp, Homo sapiens
  chr3:128202417-128202477
  hyper
cagaggacaggagtccggcccgtggacactcaacttcggggatcccggagcagagtgggg

SEQ ID NO: 6961 - DNA, 222 bp, Homo sapiens
  chr3:128205402-128205624
  hyper
tagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcat

SEQ ID NO: 6962 - DNA, 67 bp, Homo sapiens
  chr3:128208538-128208605
  hyper
tggcgttcccctcaacgcgtgcggtcccgccggggcccactgtctctccgtccgtctgtctctcaac

SEQ ID NO: 6963 - DNA, 283 bp, Homo sapiens
  chr3:128208949-128209232
  hyper
taccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaacc

SEQ ID NO: 6964 - DNA, 220 bp, Homo sapiens; identical to SEQ ID NO: 2255
  chr3:128273832-128274052
  hyper

SEQ ID NO: 6965 - DNA, 347 bp, Homo sapiens; identical to SEQ ID NO: 2256
  chr3:128274308-128274655
  hyper

SEQ ID NO: 6966 - DNA, 236 bp, Homo sapiens
  chr3:128417201-128417437
  hyper
ctaccgcagccttcccgcctgggtctcccacaggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacc

SEQ ID NO: 6967 - DNA, 184 bp, Homo sapiens; identical to SEQ ID NO: 2257
  chr3:128720163-128720347
  hyper

SEQ ID NO: 6968 - DNA, 116 bp, Homo sapiens; identical to SEQ ID NO: 2258
  chr3:128720418-128720534
  hyper

SEQ ID NO: 6969 - DNA, 23 bp, Homo sapiens
  chr3:128720566-128720589
  hyper
cgccctggcgcaccactacgggc

SEQ ID NO: 6970 - DNA, 54 bp, Homo sapiens; identical to SEQ ID NO: 2260
  chr3:128720830-128720884
  hyper

SEQ ID NO: 6971 - DNA, 430 bp, Homo sapiens; identical to SEQ ID NO: 2261
  chr3:128720885-128721315
  hyper

SEQ ID NO: 6972 - DNA, 82 bp, Homo sapiens; identical to SEQ ID NO: 2262
  chr3:128764525-128764607
  hyper

SEQ ID NO: 6973 - DNA, 92 bp, Homo sapiens; identical to SEQ ID NO: 311
  chr3:129693108-129693200
  hyper

SEQ ID NO: 6974 - DNA, 195 bp, Homo sapiens; identical to SEQ ID NO: 312
  chr3:129693304-129693499
  hyper

SEQ ID NO: 6975 - DNA, 259 bp, Homo sapiens; identical to SEQ ID NO: 313
  chr3:129693954-129694213
  hyper

SEQ ID NO: 6976 - DNA, 159 bp, Homo sapiens
  chr3:130064451-130064610
  hyper
agttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggca

SEQ ID NO: 6977 - DNA, 37 bp, Homo sapiens
  chr3:130235542-130235579
  hyper
tggaccttaatctcacggtcttcgttcccacggaaaa

SEQ ID NO: 6978 - DNA, 93 bp, Homo sapiens; identical to SEQ ID NO: 2266
  chr3:130235834-130235927
  hyper

SEQ ID NO: 6979 - DNA, 13 bp, Homo sapiens
  chr3:130236173-130236186
  hyper
cgtccagaggaaa

SEQ ID NO: 6980 - DNA, 122 bp, Homo sapiens
  chr3:132757065-132757187
  hyper
tggctggtctcaccacgtgaccggcgctgagccttccgtgcgaccggattggctgtcgcggacgctgacggacaaggccggggcgggccagagcctggtcggaggggcgcgcgcgggggccc

SEQ ID NO: 6981 - DNA, 95 bp, Homo sapiens
  chr3:132757780-132757875
  hyper
ctcctgcctaggtgccggcggcctcgccggggacggagcctccgtgctgcccgggaggttgctctgccggctggacctggcggttttcaccccag

SEQ ID NO: 6982 - DNA, 81 bp, Homo sapiens
  chr3:133646291-133646372
  hyper
gagaggaagttttctcgaggctgtgtcccgtgagcaggcgccggtgggctcagccgccgggccctccgagtaggggaaggc

SEQ ID NO: 6983 - DNA, 63 bp, Homo sapiens
  chr3:134125472-134125535
  hyper
tccttgtttgcctctcgccaggcctaagccccgggtccccttgggtgtcgtccaggacgccag

SEQ ID NO: 6984 - DNA, 53 bp, Homo sapiens
  chr3:134370030-134370083
  hyper
ttgaaaggaaatccccgggcccaagccttgacctgcaccggggccatagtcag

SEQ ID NO: 6985 - DNA, 298 bp, Homo sapiens
  chr3:134514320-134514618
  hyper
gcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggtaacgtaccctccacggagcaagttggctgctggtgccggccgccttgggactgctgtgctccgcggttcgcggggttcctctggc

SEQ ID NO: 6986 - DNA, 151 bp, Homo sapiens
  chr3:134515381-134515532
  hyper
caaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctggg

SEQ ID NO: 6987 - DNA, 175 bp, Homo sapiens; identical to SEQ ID NO: 2267
  chr3:134515771-134515946
  hyper

SEQ ID NO: 6988 - DNA, 112 bp, Homo sapiens
  chr3:134516192-134516304
  hyper
tatatacccccaaaccgggcaggaaagccagggtgagcgcatttgcaagggcaattccagactggacttgcagcattggggtggcgtcatgcaggtccgaggctcggtccgg

SEQ ID NO: 6989 - DNA, 99 bp, Homo sapiens
  chr3:136537631-136537730
  hyper
gaaggaatagacttgcgacttttaagcgcaaacaatgggtggaaatggacagaaactgcctccgtgcccacttgcagcggactacgtagccctggcaga

SEQ ID NO: 6990 - DNA, 60 bp, Homo sapiens
  chr3:136538655-136538715
  hyper
tttcccaagggaagacgagggcaagggttagtggaggaagggcctcgtcacggccgagag

SEQ ID NO: 6991 - DNA, 30 bp, Homo sapiens
  chr3:137479200-137479230
  hyper
gcgagctgaagcccacgctgctctcaggct

SEQ ID NO: 6992 - DNA, 165 bp, Homo sapiens; identical to SEQ ID NO: 2268
  chr3:137479522-137479687
  hyper

SEQ ID NO: 6993 - DNA, 698 bp, Homo sapiens; identical to SEQ ID NO: 314
  chr3:137479943-137480641
  hyper

SEQ ID NO: 6994 - DNA, 145 bp, Homo sapiens; identical to SEQ ID NO: 315
  chr3:137481170-137481315
  hyper

SEQ ID NO: 6995 - DNA, 30 bp, Homo sapiens
  chr3:137483930-137483960
  hyper
cggacccgctcaaggcggctggcctgcccg

SEQ ID NO: 6996 - DNA, 283 bp, Homo sapiens; identical to SEQ ID NO: 2271
  chr3:137484405-137484688
  hyper

SEQ ID NO: 6997 - DNA, 54 bp, Homo sapiens
  chr3:137485531-137485585
  hyper
ttttaaaaaaccaaacgctgaaggagcagggagaagcaccgagtctcctgggaa

SEQ ID NO: 6998 - DNA, 373 bp, Homo sapiens
  chr3:137485937-137486310
  hyper
cttttctttcccctccgggtgaatgttttcttgaagattattgtctttcctgagaaaggaccctccgatgttatccagcaaaactctttggaatttgttctcaaaatcgaagggtgctttccacccttggtcttggagtctcaccccaaaagccgcgctcacgcgtggttttccttaatttgcgtgcttttcccactggctttgatatgctgtggggtgggaggtggggcagcctagaggtttgtgggctttctgctgctgttgagagatttgtacgcttgcctccgctgtttccaaaggagtcggtggctcgaagtgcacgggaaacgttgtcaacagacaccaaagccgaaacccgcggattagcatattg

SEQ ID NO: 6999 - DNA, 16 bp, Homo sapiens
  chr3:137487065-137487081
  hyper
gaggggcaaaggcctc

SEQ ID NO: 7000 - DNA, 17 bp, Homo sapiens
  chr3:137487082-137487099
  hyper
gacggtggctgaagctg

SEQ ID NO: 7001 - DNA, 15 bp, Homo sapiens
  chr3:137487989-137488004
  hyper
gacccaaatacatgc

SEQ ID NO: 7002 - DNA, 75 bp, Homo sapiens
  chr3:137488337-137488412
  hyper
taatttccttaggcccgatgactttaaagacggaaaagaccagctactttgagtaaattacgctgaggtgtgagt

SEQ ID NO: 7003 - DNA, 519 bp, Homo sapiens; identical to SEQ ID NO: 316
  chr3:137488807-137489326
  hyper

SEQ ID NO: 7004 - DNA, 15 bp, Homo sapiens
  chr3:137489684-137489699
  hyper
agagaaagacctgac

SEQ ID NO: 7005 - DNA, 1135 bp, Homo sapiens; identical to SEQ ID NO: 318
  chr3:137489875-137491010
  hyper

SEQ ID NO: 7006 - DNA, 167 bp, Homo sapiens
  chr3:138154014-138154181
  hyper
gttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtc

SEQ ID NO: 7007 - DNA, 46 bp, Homo sapiens
  chr3:138656843-138656889
  hyper
gacccccgatcctgccggtgaggggagggagcgagaaggagtgcgc

SEQ ID NO: 7008 - DNA, 171 bp, Homo sapiens; identical to SEQ ID NO: 2275
  chr3:138657617-138657788
  hyper

SEQ ID NO: 7009 - DNA, 161 bp, Homo sapiens; identical to SEQ ID NO: 319
  chr3:138658703-138658864
  hyper

SEQ ID NO: 7010 - DNA, 93 bp, Homo sapiens; identical to SEQ ID NO: 2277
  chr3:138662087-138662180
  hyper

SEQ ID NO: 7011 - DNA, 167 bp, Homo sapiens; identical to SEQ ID NO: 2278
  chr3:138662281-138662448
  hyper

SEQ ID NO: 7012 - DNA, 42 bp, Homo sapiens; identical to SEQ ID NO: 2279
  chr3:138664141-138664183
  hyper

SEQ ID NO: 7013 - DNA, 303 bp, Homo sapiens; identical to SEQ ID NO: 2280
  chr3:138664928-138665231
  hyper

SEQ ID NO: 7014 - DNA, 668 bp, Homo sapiens; identical to SEQ ID NO: 320
  chr3:138665557-138666225
  hyper

SEQ ID NO: 7015 - DNA, 352 bp, Homo sapiens; identical to SEQ ID NO: 2282
  chr3:138668757-138669109
  hyper

SEQ ID NO: 7016 - DNA, 196 bp, Homo sapiens; identical to SEQ ID NO: 2283
  chr3:138669140-138669336
  hyper

SEQ ID NO: 7017 - DNA, 105 bp, Homo sapiens; identical to SEQ ID NO: 321
  chr3:138679188-138679293
  hyper

SEQ ID NO: 7018 - DNA, 104 bp, Homo sapiens
  chr3:139258212-139258316
  hyper
gaggcaggcaggcagcgtctcgggagggctctagggagcggcccggagctgctcggcggggcgcccagggcgcagcgggcagcgcttaccgagggcgcgcaggt

SEQ ID NO: 7019 - DNA, 308 bp, Homo sapiens
  chr3:139396463-139396771
  hyper
aggggccaggagtcacgtgggcccgggcattcagccgcgatccaggtcctagtgggctgacgaggggcccacgctgcgcttacctgctatttgcagggctcagcaacggcgctcggcgagtctcgggggactgcgggggactaggggacctgctgggcctagcaggggctgtcggtcagcgcgcggcccggcgcccgaggtccgagagggaaacgacgtttggtctcgggactcaaggctgcctccggcccgggcagcctcaggtctagatcccctagtacctgagctggaggcggggccaaggcgaa

SEQ ID NO: 7020 - DNA, 82 bp, Homo sapiens; identical to SEQ ID NO: 322
  chr3:139653491-139653573
  hyper

SEQ ID NO: 7021 - DNA, 298 bp, Homo sapiens; identical to SEQ ID NO: 323
  chr3:139653574-139653872
  hyper

SEQ ID NO: 7022 - DNA, 682 bp, Homo sapiens; identical to SEQ ID NO: 324
  chr3:139653873-139654555
  hyper

SEQ ID NO: 7023 - DNA, 273 bp, Homo sapiens
  chr3:139654788-139655061
  hyper
ctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtca

SEQ ID NO: 7024 - DNA, 674 bp, Homo sapiens; identical to SEQ ID NO: 325
  chr3:140769628-140770302
  hyper

SEQ ID NO: 7025 - DNA, 183 bp, Homo sapiens; identical to SEQ ID NO: 326
  chr3:140770407-140770590
  hyper

SEQ ID NO: 7026 - DNA, 40 bp, Homo sapiens; identical to SEQ ID NO: 327
  chr3:140770643-140770683
  hyper

SEQ ID NO: 7027 - DNA, 356 bp, Homo sapiens; identical to SEQ ID NO: 328
  chr3:140770684-140771040
  hyper

SEQ ID NO: 7028 - DNA, 48 bp, Homo sapiens
  chr3:140771752-140771800
  hyper
gggagtggctgctcccgccggcccatggccaagcgcagacggctgccg

SEQ ID NO: 7029 - DNA, 93 bp, Homo sapiens
  chr3:141516089-141516182
  hyper
agtggcggcagaaagcgagccctgagaagccaggggcaggagcggcctccgcgcgacactgcggcgctcctgattctgcggcctggggccgag

SEQ ID NO: 7030 - DNA, 355 bp, Homo sapiens; identical to SEQ ID NO: 329
  chr3:141516389-141516744
  hyper

SEQ ID NO: 7031 - DNA, 192 bp, Homo sapiens
  chr3:142443659-142443851
  hyper
tccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagcccc

SEQ ID NO: 7032 - DNA, 41 bp, Homo sapiens
  chr3:142607792-142607833
  hyper
cccctccgcacccaccgcgctcacaccgccgctcacactgg

SEQ ID NO: 7033 - DNA, 60 bp, Homo sapiens
  chr3:142681935-142681995
  hyper
ggtaggcttcagcaccgaggctaggcactcctgggccgtgcacggcagacgccggtagcc

SEQ ID NO: 7034 - DNA, 1001 bp, Homo sapiens
  chr3:142682049-142683050
  hyper
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctc

SEQ ID NO: 7035 - DNA, 34 bp, Homo sapiens
  chr3:142683110-142683144
  hyper
ggcctgtctacgcactacacgaaggcttagttgg

SEQ ID NO: 7036 - DNA, 207 bp, Homo sapiens; identical to SEQ ID NO: 2293
  chr3:142838112-142838319
  hyper

SEQ ID NO: 7037 - DNA, 168 bp, Homo sapiens; identical to SEQ ID NO: 2294
  chr3:142838479-142838647
  hyper

SEQ ID NO: 7038 - DNA, 160 bp, Homo sapiens; identical to SEQ ID NO: 2295
  chr3:142838876-142839036
  hyper

SEQ ID NO: 7039 - DNA, 86 bp, Homo sapiens; identical to SEQ ID NO: 2296
  chr3:142839440-142839526
  hyper

SEQ ID NO: 7040 - DNA, 16 bp, Homo sapiens
  chr3:142839562-142839578
  hyper
cggcccgagtcccggc

SEQ ID NO: 7041 - DNA, 110 bp, Homo sapiens; identical to SEQ ID NO: 2298
  chr3:142839579-142839689
  hyper

SEQ ID NO: 7042 - DNA, 119 bp, Homo sapiens; identical to SEQ ID NO: 2299
  chr3:142839783-142839902
  hyper

SEQ ID NO: 7043 - DNA, 47 bp, Homo sapiens; identical to SEQ ID NO: 2300
  chr3:142839944-142839991
  hyper

SEQ ID NO: 7044 - DNA, 136 bp, Homo sapiens; identical to SEQ ID NO: 2301
  chr3:142839992-142840128
  hyper

SEQ ID NO: 7045 - DNA, 33 bp, Homo sapiens; identical to SEQ ID NO: 2302
  chr3:142840221-142840254
  hyper

SEQ ID NO: 7046 - DNA, 33 bp, Homo sapiens
  chr3:145878520-145878553
  hyper
ttctggggaagaccccggcggtcctggagagga

SEQ ID NO: 7047 - DNA, 30 bp, Homo sapiens
  chr3:147072640-147072670
  hyper
gccgggcgggccggccgctcacaatggagc

SEQ ID NO: 7048 - DNA, 32 bp, Homo sapiens
  chr3:147074974-147075006
  hyper
gattgggctgtctggcgcggcttccaattcca

SEQ ID NO: 7049 - DNA, 229 bp, Homo sapiens; identical to SEQ ID NO: 330
  chr3:147078959-147079188
  hyper

SEQ ID NO: 7050 - DNA, 197 bp, Homo sapiens
  chr3:147087395-147087592
  hyper
tcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaaccccagagtcgcagctgtgcgcatccacaggcaa

SEQ ID NO: 7051 - DNA, 56 bp, Homo sapiens
  chr3:147088467-147088523
  hyper
acaaaagcggatctgcggcgttatgaaaaatggcctgggcgcggagaatgtcacag

SEQ ID NO: 7052 - DNA, 37 bp, Homo sapiens
  chr3:147088973-147089010
  hyper
agcgaacgcctgaggcggtaggcgggttcattgcagg

SEQ ID NO: 7053 - DNA, 36 bp, Homo sapiens
  chr3:147090647-147090683
  hyper
ggcgactgaggatcccgccagcgcacccagcctact

SEQ ID NO: 7054 - DNA, 49 bp, Homo sapiens
  chr3:147096028-147096077
  hyper
aggagtccctgaccccgtgccttggctggagcgccgtttccctggacga

SEQ ID NO: 7055 - DNA, 49 bp, Homo sapiens
  chr3:147098421-147098470
  hyper
ttcagactgcaggtgcgaagtgggccggcgcgcccgaccacattatgtc

SEQ ID NO: 7056 - DNA, 30 bp, Homo sapiens
  chr3:147105883-147105913
  hyper
taaacgtgggcaagtcgggttctagaaagg

SEQ ID NO: 7057 - DNA, 90 bp, Homo sapiens; identical to SEQ ID NO: 2304
  chr3:147108806-147108896
  hyper

SEQ ID NO: 7058 - DNA, 387 bp, Homo sapiens; identical to SEQ ID NO: 2305
  chr3:147109225-147109612
  hyper

SEQ ID NO: 7059 - DNA, 497 bp, Homo sapiens; identical to SEQ ID NO: 331
  chr3:147110228-147110725
  hyper

SEQ ID NO: 7060 - DNA, 84 bp, Homo sapiens
  chr3:147111050-147111134
  hyper
agtgataccggcagccgggaagttcgcaggcccctaggaggccaggtgaggccgcgccccagcttgctccggagctgcaggagg

SEQ ID NO: 7061 - DNA, 122 bp, Homo sapiens
  chr3:147111988-147112110
  hyper
ccagactctgtagttcgttgttggtcgtgtttgtttgtttgtttgtttttgtttgttgtttcccccaccccccaccgctaatgaatcaggaccgcgaaccgaaagaacgcacaaaattctgt

SEQ ID NO: 7062 - DNA, 39 bp, Homo sapiens
  chr3:147114179-147114218
  hyper
ctcctcgtggaggcccgggaacaccgaggggctggaggc

SEQ ID NO: 7063 - DNA, 75 bp, Homo sapiens
  chr3:147126992-147127067
  hyper
cgggccaatgagctgcgcgcggcgcctcggcgcgccctccgttggcgcggcggctgagggcggggggaatgcggg

SEQ ID NO: 7064 - DNA, 62 bp, Homo sapiens
  chr3:147127850-147127912
  hyper
cgagggtggggggggcgggggaggccggggctcgccccgagcagccacgatgctcctggacg

SEQ ID NO: 7065 - DNA, 101 bp, Homo sapiens
  chr3:147136900-147137001
  hyper
caccgaaggctgggtcgtcagcgtttgagggaccctcccgccaccccgcagcctggcggggcgctttccaaatcgtcgcggcaggctctggccgggcaggg

SEQ ID NO: 7066 - DNA, 89 bp, Homo sapiens
  chr3:147137075-147137164
  hyper
cgcgggctagagagagaaccaagcagaggctccggcctgtgaaagtcgctggctaggctcccaaaatagtgcggcggggtagctgcacg

SEQ ID NO: 7067 - DNA, 231 bp, Homo sapiens; identical to SEQ ID NO: 2307
  chr3:147138768-147138999
  hyper

SEQ ID NO: 7068 - DNA, 30 bp, Homo sapiens
  chr3:147139541-147139571
  hyper
ggctccccagtgaggcgggagcgaaaagag

SEQ ID NO: 7069 - DNA, 480 bp, Homo sapiens
  chr3:148415340-148415820
  hyper
agaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtg

SEQ ID NO: 7070 - DNA, 30 bp, Homo sapiens
  chr3:148416021-148416051
  hyper
ggaccaaggaaagagcgaccgtagttctgg

SEQ ID NO: 7071 - DNA, 155 bp, Homo sapiens
  chr3:149375236-149375391
  hyper
atcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaac

SEQ ID NO: 7072 - DNA, 65 bp, Homo sapiens
  chr3:150802935-150803000
  hyper
atcaagatcctggcacgtagcgaaggctccataaatggcagccatcattcttggccaagtgcggg

SEQ ID NO: 7073 - DNA, 573 bp, Homo sapiens
  chr3:150803025-150803598
  hyper
cggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccggg

SEQ ID NO: 7074 - DNA, 64 bp, Homo sapiens
  chr3:150803966-150804030
  hyper
agccgccgaggggaccgtagctgcggatgcgccactggaacctggcgggcgtctaggaggcacc

SEQ ID NO: 7075 - DNA, 161 bp, Homo sapiens
  chr3:150804735-150804896
  hyper
gctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgc

SEQ ID NO: 7076 - DNA, 98 bp, Homo sapiens
  chr3:150804936-150805034
  hyper
cgggggccaggctgggggtgctgggcgaccccccggcggcggagaccgagcggctgtcagtccccgcgctccactggggcgctcgctttccatgtgcc

SEQ ID NO: 7077 - DNA, 211 bp, Homo sapiens
  chr3:152553275-152553486
  hyper
cggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggctttt

SEQ ID NO: 7078 - DNA, 226 bp, Homo sapiens; identical to SEQ ID NO: 2308
  chr3:153839727-153839953
  hyper

SEQ ID NO: 7079 - DNA, 30 bp, Homo sapiens
  chr3:154146133-154146163
  hyper
atccttggccaccaccgatatggaaaacta

SEQ ID NO: 7080 - DNA, 364 bp, Homo sapiens
  chr3:154146601-154146965
  hyper
gagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccg

SEQ ID NO: 7081 - DNA, 306 bp, Homo sapiens
  chr3:154797472-154797778
  hyper
gtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcc

SEQ ID NO: 7082 - DNA, 184 bp, Homo sapiens
  chr3:154797835-154798019
  hyper
cgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctg

SEQ ID NO: 7083 - DNA, 236 bp, Homo sapiens; identical to SEQ ID NO: 332
  chr3:156009064-156009300
  hyper

SEQ ID NO: 7084 - DNA, 265 bp, Homo sapiens; identical to SEQ ID NO: 333
  chr3:156009318-156009583
  hyper

SEQ ID NO: 7085 - DNA, 30 bp, Homo sapiens
  chr3:156009875-156009905
  hyper
tctcaaagagtccaccgcaaagcagactgg

SEQ ID NO: 7086 - DNA, 30 bp, Homo sapiens
  chr3:157155252-157155282
  hyper
caaggcaggcctgggcgggctgctaacgtg

SEQ ID NO: 7087 - DNA, 30 bp, Homo sapiens
  chr3:157156090-157156120
  hyper
cgttagggatttccacgtcttctaatttta

SEQ ID NO: 7088 - DNA, 32 bp, Homo sapiens
  chr3:157261124-157261156
  hyper
acccggtccccgccccgcgtgctcaggctgaa

SEQ ID NO: 7089 - DNA, 101 bp, Homo sapiens; identical to SEQ ID NO: 2311
  chr3:157812157-157812258
  hyper

SEQ ID NO: 7090 - DNA, 209 bp, Homo sapiens; identical to SEQ ID NO: 2312
  chr3:157812436-157812645
  hyper

SEQ ID NO: 7091 - DNA, 60 bp, Homo sapiens; identical to SEQ ID NO: 2313
  chr3:157812973-157813033
  hyper

SEQ ID NO: 7092 - DNA, 4 bp, Homo sapiens
  chr3:157813601-157813605
  hyper
gggc

SEQ ID NO: 7093 - DNA, 126 bp, Homo sapiens; identical to SEQ ID NO: 2315
  chr3:157821536-157821662
  hyper

SEQ ID NO: 7094 - DNA, 47 bp, Homo sapiens
  chr3:157823073-157823120
  hyper
ggctagctttagtcccgccgtctggttcagcaccccctcctgcagcc

SEQ ID NO: 7095 - DNA, 239 bp, Homo sapiens
  chr3:157823138-157823377
  hyper
cgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccc

SEQ ID NO: 7096 - DNA, 106 bp, Homo sapiens
  chr3:157823732-157823838
  hyper
ctcccggtacgtgatcgcctccttcttctccttcactttctggtcaaaagacttggagacgaacgccgtaagttcttccatcgccgccgcacgtcagcccggcgct

SEQ ID NO: 7097 - DNA, 211 bp, Homo sapiens
  chr3:157824698-157824909
  hyper
gtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggc

SEQ ID NO: 7098 - DNA, 59 bp, Homo sapiens; identical to SEQ ID NO: 2316
  chr3:157825176-157825235
  hyper

SEQ ID NO: 7099 - DNA, 92 bp, Homo sapiens
  chr3:158288920-158289012
  hyper
aatgggaaagcagctcggtgtcacgcacctcctatcccggcgggcaccgcctgcgccgcggcgagtgaggcgtcgtccgtactggaggctag

SEQ ID NO: 7100 - DNA, 169 bp, Homo sapiens
  chr3:159756687-159756856
  hyper
tgcgcttacctgctccgcacgacctctgcggcttgggggctctcagctctgtcgctgcggggctccaggctggtgcttgtgctgagaatgactgcgggaggggctcgcgtgcccagcactgcaccgcgaggcgaccaaccgctgacatgtggggcgattgggtggacag

SEQ ID NO: 7101 - DNA, 109 bp, Homo sapiens
  chr3:159944437-159944546
  hyper
ccctctgccttgcctcgtattgtggttcactagtaagtgcctgcttccctagtcaaagagaacacgtgagccctttggtgcgtcgagagaagggcggtcttctttaggg

SEQ ID NO: 7102 - DNA, 60 bp, Homo sapiens
  chr3:160822815-160822875
  hyper
gagacccgagacccacggtgcggcggctcaacctgggccacgctccgctctagaggagtg

SEQ ID NO: 7103 - DNA, 30 bp, Homo sapiens
  chr3:164912404-164912434
  hyper
ctcccccccatcccccgcccagcactttgg

SEQ ID NO: 7104 - DNA, 572 bp, Homo sapiens
  chr3:164913300-164913872
  hyper
tgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaatt

SEQ ID NO: 7105 - DNA, 34 bp, Homo sapiens
  chr3:164914188-164914222
  hyper
agcaccctcacttctcgagcgggagaaggtgcgg

SEQ ID NO: 7106 - DNA, 188 bp, Homo sapiens
  chr3:164915057-164915245
  hyper
atgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaatacgtgtaataacacgt

SEQ ID NO: 7107 - DNA, 30 bp, Homo sapiens
  chr3:167097947-167097977
  hyper
ccgcaccaactagcccgggcttgctgcccg

SEQ ID NO: 7108 - DNA, 328 bp, Homo sapiens
  chr3:167968002-167968330
  hyper
ctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattc

SEQ ID NO: 7109 - DNA, 42 bp, Homo sapiens
  chr3:169376701-169376743
  hyper
cttgtccttctagcccggggaggagggcgtccccccttcctg

SEQ ID NO: 7110 - DNA, 30 bp, Homo sapiens
  chr3:169530363-169530393
  hyper
cctgcagctgtgaggcggctacacgagcct

SEQ ID NO: 7111 - DNA, 107 bp, Homo sapiens
  chr3:170136940-170137047
  hyper
ctgggtggtgacctgcggctacaccatccccacctgccgcaagctggatgagctgggctccaaggggctgtgggccgactgcgtcatggccacggggctgtaccact

SEQ ID NO: 7112 - DNA, 64 bp, Homo sapiens
  chr3:170302590-170302654
  hyper
cagggtgacatcctgcggcccttgggcaattcgggccagtgacgttcaccgacactcaggcggg

SEQ ID NO: 7113 - DNA, 53 bp, Homo sapiens
  chr3:170303035-170303088
  hyper
cctggacaccgctcccgtcacgtcctcttcgccgctcccgggagagtcaccac

SEQ ID NO: 7114 - DNA, 44 bp, Homo sapiens
  chr3:170303379-170303423
  hyper
cggcgccggagccgcgctggcccccgccccgcccggcagctccc

SEQ ID NO: 7115 - DNA, 54 bp, Homo sapiens
  chr3:170303790-170303844
  hyper
gggaagtggtggtggcggcaaaggaaggcaggaggcagccgctgctgctgaaca

SEQ ID NO: 7116 - DNA, 30 bp, Homo sapiens
  chr3:170625828-170625858
  hyper
agtcgcagaggagctcgctgagggtgggga

SEQ ID NO: 7117 - DNA, 342 bp, Homo sapiens; identical to SEQ ID NO: 2317
  chr3:172165443-172165785
  hyper

SEQ ID NO: 7118 - DNA, 368 bp, Homo sapiens; identical to SEQ ID NO: 2318
  chr3:172165866-172166234
  hyper

SEQ ID NO: 7119 - DNA, 49 bp, Homo sapiens; identical to SEQ ID NO: 2319
  chr3:172166235-172166284
  hyper

SEQ ID NO: 7120 - DNA, 19 bp, Homo sapiens
  chr3:172166494-172166513
  hyper
tcccaacacatcctccggc

SEQ ID NO: 7121 - DNA, 15 bp, Homo sapiens
  chr3:172166999-172167014
  hyper
cggatctcccacccg

SEQ ID NO: 7122 - DNA, 257 bp, Homo sapiens; identical to SEQ ID NO: 2320
  chr3:172167660-172167917
  hyper

SEQ ID NO: 7123 - DNA, 53 bp, Homo sapiens
  chr3:173114201-173114254
  hyper
tttacatgcaggaaacgtatatatgtttatataccgaccgcataatatataaa

SEQ ID NO: 7124 - DNA, 87 bp, Homo sapiens
  chr3:173114500-173114587
  hyper
gcgtccgccgagctccggcgtttaccttaatcccggggattgccgagaacttcctattccctgcctctccttcgccttccccacctt

SEQ ID NO: 7125 - DNA, 120 bp, Homo sapiens; identical to SEQ ID NO: 2321
  chr3:173115047-173115167
  hyper

SEQ ID NO: 7126 - DNA, 39 bp, Homo sapiens
  chr3:173115655-173115694
  hyper
gaggccgggagagcccgtccgagccggagagaccggaga

SEQ ID NO: 7127 - DNA, 210 bp, Homo sapiens
  chr3:173115965-173116175
  hyper
gaaccctcggcggagcgcagaggagctgctttcagccttctgctctccccaggccctccggctagttctggggttggttccgccggttagtttgacagggataagaaagttgctcttcttccccacaacgtttcctgagaggtggttttcagatctgtgtgtttccagtcaagatgtcactccctagatcccccgcgttgagcaactaat

SEQ ID NO: 7128 - DNA, 283 bp, Homo sapiens; identical to SEQ ID NO: 2322
  chr3:173302927-173303210
  hyper

SEQ ID NO: 7129 - DNA, 858 bp, Homo sapiens; identical to SEQ ID NO: 334
  chr3:179168782-179169640
  hyper

SEQ ID NO: 7130 - DNA, 255 bp, Homo sapiens; identical to SEQ ID NO: 335
  chr3:179754505-179754760
  hyper

SEQ ID NO: 7131 - DNA, 70 bp, Homo sapiens; identical to SEQ ID NO: 336
  chr3:179754803-179754873
  hyper

SEQ ID NO: 7132 - DNA, 286 bp, Homo sapiens; identical to SEQ ID NO: 337
  chr3:179755086-179755372
  hyper

SEQ ID NO: 7133 - DNA, 308 bp, Homo sapiens
  chr3:180397489-180397797
  hyper
ggatcgctcccggagcgtgtgaaaactgtggcccccggagctggctggaggaccacggggcagctggctggaagtaaaccacacgatcctccgattgcctgggggaagacgggagccaacagggattataaactaagtttcttttcaaggtgtgtttgctgtgttgtgtagatttcagctactacagtaggtgaaagtagaccgaagtgaactggtgtttggaaacaactctctctctggcatcactgggatgttctgatcgtcgcctgtttcagtcggccagccttcctcaccgcactcaccggccc

SEQ ID NO: 7134 - DNA, 41 bp, Homo sapiens
  chr3:180398001-180398042
  hyper
caaaaggcaatgttccgctggagaggcgccccctttagacc

SEQ ID NO: 7135 - DNA, 27 bp, Homo sapiens
  chr3:181413421-181413448
  hyper
gacccacccagccgggcccgatccctc

SEQ ID NO: 7136 - DNA, 449 bp, Homo sapiens
  chr3:181413704-181414153
  hyper
cgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggt

SEQ ID NO: 7137 - DNA, 46 bp, Homo sapiens
  chr3:181419696-181419742
  hyper
tgttggctcagaaaccgtgtaatttctcatccgataggagtttctt

SEQ ID NO: 7138 - DNA, 483 bp, Homo sapiens; identical to SEQ ID NO: 2328
  chr3:181419975-181420458
  hyper

SEQ ID NO: 7139 - DNA, 71 bp, Homo sapiens
  chr3:181421249-181421320
  hyper
acctcccaaaattagcgaattcgagataacatttcaaggggaattgctatttagtgcgatgagagatgact

SEQ ID NO: 7140 - DNA, 743 bp, Homo sapiens; identical to SEQ ID NO: 338
  chr3:181421539-181422282
  hyper

SEQ ID NO: 7141 - DNA, 250 bp, Homo sapiens
  chr3:181422925-181423175
  hyper
tcagagccccagctccgaaggagcctttaaagattatcaggccagcgatctgagaattccattgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtg

SEQ ID NO: 7142 - DNA, 422 bp, Homo sapiens; identical to SEQ ID NO: 2330
  chr3:181428388-181428810
  hyper

SEQ ID NO: 7143 - DNA, 348 bp, Homo sapiens; identical to SEQ ID NO: 2331
  chr3:181430741-181431089
  hyper

SEQ ID NO: 7144 - DNA, 89 bp, Homo sapiens
  chr3:181437210-181437299
  hyper
agcgcgccggcctcccgccggctgccctggggagcgcgcagtgcccagtgctgagagccgacgcgcgggcaaattgaggccgagctgac

SEQ ID NO: 7145 - DNA, 161 bp, Homo sapiens
  chr3:181437300-181437461
  hyper
agctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtcta

SEQ ID NO: 7146 - DNA, 223 bp, Homo sapiens
  chr3:181438200-181438423
  hyper
ggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagacccc

SEQ ID NO: 7147 - DNA, 30 bp, Homo sapiens
  chr3:181440785-181440815
  hyper
gaccttccaagagttcgttttacatttgtt

SEQ ID NO: 7148 - DNA, 729 bp, Homo sapiens; identical to SEQ ID NO: 339
  chr3:181441019-181441748
  hyper

SEQ ID NO: 7149 - DNA, 448 bp, Homo sapiens; identical to SEQ ID NO: 340
  chr3:181441962-181442410
  hyper

SEQ ID NO: 7150 - DNA, 536 bp, Homo sapiens; identical to SEQ ID NO: 2334
  chr3:181443014-181443550
  hyper

SEQ ID NO: 7151 - DNA, 91 bp, Homo sapiens; identical to SEQ ID NO: 2335
  chr3:181444434-181444525
  hyper

SEQ ID NO: 7152 - DNA, 157 bp, Homo sapiens; identical to SEQ ID NO: 2336
  chr3:181444612-181444769
  hyper

SEQ ID NO: 7153 - DNA, 120 bp, Homo sapiens; identical to SEQ ID NO: 2337
  chr3:181444829-181444949
  hyper

SEQ ID NO: 7154 - DNA, 1 bp, Homo sapiens
  chr3:181444988-181444989
  hyper
c

SEQ ID NO: 7155 - DNA, 474 bp, Homo sapiens; identical to SEQ ID NO: 2339
  chr3:181444990-181445464
  hyper

SEQ ID NO: 7156 - DNA, 15 bp, Homo sapiens
  chr3:181445710-181445725
  hyper
cgtaacaccatcatc

SEQ ID NO: 7157 - DNA, 62 bp, Homo sapiens; identical to SEQ ID NO: 2341
  chr3:181445799-181445861
  hyper

SEQ ID NO: 7158 - DNA, 152 bp, Homo sapiens
  chr3:182896884-182897036
  hyper
cccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctgg

SEQ ID NO: 7159 - DNA, 30 bp, Homo sapiens
  chr3:182897285-182897315
  hyper
gtcgccctgcaattccgagaagaaagtcag

SEQ ID NO: 7160 - DNA, 165 bp, Homo sapiens
  chr3:183145371-183145536
  hyper
cacccaccctactcccgtcagaagcagctaacggatggtaacagcccagcagccctcggtttggagctcaacggactcggcaaccacctggtgaaggcaccagcctcggccccccgacccccaccagcggcgcgccccagggatgccccccgctgggcaccgcag

SEQ ID NO: 7161 - DNA, 189 bp, Homo sapiens
  chr3:183980238-183980427
  hyper
aggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgcc

SEQ ID NO: 7162 - DNA, 98 bp, Homo sapiens
  chr3:184243116-184243214
  hyper
ccttgctgctgagggcgcggtgggacccgtcgcagggccagctgctccggcaggtgcccccaaagggtcccgcaggtgatcctcggggactgagcgcc

SEQ ID NO: 7163 - DNA, 76 bp, Homo sapiens
  chr3:184301502-184301578
  hyper
ccgcgccgccgcagccggcccgggggaggggcgccccgcacggctaagctctctgcgtccccggggcggacgcggg

SEQ ID NO: 7164 - DNA, 182 bp, Homo sapiens
  chr3:184871097-184871279
  hyper
agtgacactggccaccgagaactgacacacgcgtccacacgctccacggagggctgcgcacacctggcccacgcccacccgaacctcctagtggcccgggccgggtgcatcgcgtagcgaggatctcacacacacagcctgtccccacaggcgtctcacatctccctcgtacacacctcccc

SEQ ID NO: 7165 - DNA, 138 bp, Homo sapiens
  chr3:186078760-186078898
  hyper
cccacgggttcacagcgctcccgggcaccactgcggcgcagccacagatcgcttcgcgctgcagcagacgctcccgccgcggggggcgactgggggaggggtctcgaccgccaccctgagttccgcagctcatccctc

SEQ ID NO: 7166 - DNA, 127 bp, Homo sapiens; identical to SEQ ID NO: 2342
  chr3:186079204-186079331
  hyper

SEQ ID NO: 7167 - DNA, 104 bp, Homo sapiens
  chr3:186079667-186079771
  hyper
accaagttgctgcaccgggtgctccctgagccggggaccccctccgccgcgccggccgccgtcttacctcaccaggcaacacttggttgcgcggtggcccgggg

SEQ ID NO: 7168 - DNA, 83 bp, Homo sapiens
  chr3:186080162-186080245
  hyper
ttccacacatgcacacgcgtgcgcacacacgaatgtggatccgctcgatgggaacctgaccccctttggtgcaactagggcgc

SEQ ID NO: 7169 - DNA, 49 bp, Homo sapiens
  chr3:186080246-186080295
  hyper
ggcatcattaggacgctttttactgacagggcttcggtttgggaggagg

SEQ ID NO: 7170 - DNA, 576 bp, Homo sapiens
  chr3:186857096-186857672
  hyper
aggtctgcgtgtcaccgacccgaacccgctccgtcgtcctgacgcccccggcctagctgcagccaccttgtcgcaggggccttggtgtctctgagactccgagacgcctcgcccccacctggcgttcggaggcggttgcctcgctgggcgcagcaattcaaccgccgcgcgccggatgctaagaccgcgatttccccggatgctagggcggtgatttcccccgtgacaggccccgccccggccccgcccaggcccgggcggtcccgccccactgagctgtggctcggggagccgtgggtccgactcctgcgtgtgatgtgtcaccaagttgactttggggtcccccattcttccttagttctctattttacctcagcgcgttgtctagctgctgcctggccacggtacttagcacacagcgtgacttaatactggataaacgaggaaaggattcgtacgccctggcggggccagaggctcacagcttgggttcccgcgagcacacgagccaggaaccgccaatgcctccagggggcgctctccctcccatcgagccaccgccgggccattggagac

SEQ ID NO: 7171 - DNA, 130 bp, Homo sapiens; identical to SEQ ID NO: 341
  chr3:187387791-187387921
  hyper

SEQ ID NO: 7172 - DNA, 183 bp, Homo sapiens; identical to SEQ ID NO: 342
  chr3:187388006-187388189
  hyper

SEQ ID NO: 7173 - DNA, 118 bp, Homo sapiens
  chr3:187456159-187456277
  hyper
acagaaagccccttccgcctacgttggcaagaacgggaacccagctccacttggtttccgcccaaagtctttagaacaggagctgccaagccgtaaggatttccgaatccgatttccc

SEQ ID NO: 7174 - DNA, 30 bp, Homo sapiens
  chr3:187456549-187456579
  hyper
cggaagggtcagagtcggtctgcaaagaac

SEQ ID NO: 7175 - DNA, 30 bp, Homo sapiens
  chr3:189838630-189838660
  hyper
gatctggccgctccgcgagccccaggtgac

SEQ ID NO: 7176 - DNA, 101 bp, Homo sapiens
  chr3:190580811-190580912
  hyper
cggcgaccccgcagccgggaccgaggcgagggccgggctccctcccgctccacgcgcagcgcggggcagggccgagccgggccgggcgagaagatggtcca

SEQ ID NO: 7177 - DNA, 1 bp, Homo sapiens
  chr3:192125828-192125829
  hyper
c

SEQ ID NO: 7178 - DNA, 406 bp, Homo sapiens; identical to SEQ ID NO: 343
  chr3:192126305-192126711
  hyper

SEQ ID NO: 7179 - DNA, 63 bp, Homo sapiens; identical to SEQ ID NO: 344
  chr3:192126786-192126849
  hyper

SEQ ID NO: 7180 - DNA, 110 bp, Homo sapiens; identical to SEQ ID NO: 345
  chr3:192126850-192126960
  hyper

SEQ ID NO: 7181 - DNA, 49 bp, Homo sapiens; identical to SEQ ID NO: 346
  chr3:192126961-192127010
  hyper

SEQ ID NO: 7182 - DNA, 59 bp, Homo sapiens; identical to SEQ ID NO: 347
  chr3:192127314-192127373
  hyper

SEQ ID NO: 7183 - DNA, 175 bp, Homo sapiens; identical to SEQ ID NO: 348
  chr3:192127556-192127731
  hyper

SEQ ID NO: 7184 - DNA, 54 bp, Homo sapiens; identical to SEQ ID NO: 349
  chr3:192127936-192127990
  hyper

SEQ ID NO: 7185 - DNA, 20 bp, Homo sapiens
  chr3:192232057-192232077
  hyper
ccctctcctgtggaacgcac

SEQ ID NO: 7186 - DNA, 13 bp, Homo sapiens
  chr3:192232078-192232091
  hyper
agcaacttttcgg

SEQ ID NO: 7187 - DNA, 21 bp, Homo sapiens
  chr3:192232798-192232819
  hyper
ccccttgagaccttccggagg

SEQ ID NO: 7188 - DNA, 103 bp, Homo sapiens
  chr3:192232849-192232952
  hyper
cgtcactgcgggtcggtgcttccttacaggtgccttctggaccggggtccttggcacctcccctgctcctgccctcggtgccggaccctgtgccctgggagcc

SEQ ID NO: 7189 - DNA, 123 bp, Homo sapiens
  chr3:192233094-192233217
  hyper
gcagggagggctggaccccggaggctgcagagcgtcagaagcgactctagggaactagggggtggggtagggaggcggggacgtggaataaagaaagctcctgggtgccggctatgagaagtc

SEQ ID NO: 7190 - DNA, 103 bp, Homo sapiens
  chr3:193776076-193776179
  hyper
cggttcctctgcagacgttcagccccttcggaaatgtaaaacccgggaagcgaaagctgcggcgacctcccagagcctctcaggcacgcggcatctctcccca

SEQ ID NO: 7191 - DNA, 100 bp, Homo sapiens; identical to SEQ ID NO: 2352
  chr3:194208467-194208567
  hyper

SEQ ID NO: 7192 - DNA, 342 bp, Homo sapiens; identical to SEQ ID NO: 2353
  chr3:194408427-194408769
  hyper

SEQ ID NO: 7193 - DNA, 220 bp, Homo sapiens; identical to SEQ ID NO: 2354
  chr3:194408838-194409058
  hyper

SEQ ID NO: 7194 - DNA, 60 bp, Homo sapiens
  chr3:196366801-196366861
  hyper
gtgggcgagctcgagcgaggttgggtggtaggaggtcagcgtccgcggcccgcagctcag

SEQ ID NO: 7195 - DNA, 102 bp, Homo sapiens
  chr3:197840446-197840548
  hyper
gaaaggcaggggaggcgcgacggggcgagggacggggaggaaagcggtctcccgcctccagggcgggccgagggctgggcccgcggggcgctcacgtccctc

SEQ ID NO: 7196 - DNA, 114 bp, Homo sapiens; identical to SEQ ID NO: 2355
  chr4:568539-568653
  hyper

SEQ ID NO: 7197 - DNA, 69 bp, Homo sapiens; identical to SEQ ID NO: 2356
  chr4:569047-569116
  hyper

SEQ ID NO: 7198 - DNA, 162 bp, Homo sapiens; identical to SEQ ID NO: 2357
  chr4:569274-569436
  hyper

SEQ ID NO: 7199 - DNA, 36 bp, Homo sapiens; identical to SEQ ID NO: 2358
  chr4:569460-569496
  hyper

SEQ ID NO: 7200 - DNA, 15 bp, Homo sapiens
  chr4:570242-570257
  hyper
ttcctcctcccggag

SEQ ID NO: 7201 - DNA, 203 bp, Homo sapiens
  chr4:570298-570501
  hyper
cgcgcccctatccggcgcgggccgctgcggaaacgcagctctccacccccagctggctctcccggaccccctgggccccaccctcagcgctccccaccgctcggcgcccctgcgtctgcgctcccctctctcccctctctatccactgggtctgggccgcacttcccgcccacccgcctgccagcggccgggaagcctgtgga

SEQ ID NO: 7202 - DNA, 853 bp, Homo sapiens; identical to SEQ ID NO: 2359
  chr4:570836-571689
  hyper

SEQ ID NO: 7203 - DNA, 44 bp, Homo sapiens
  chr4:788891-788935
  hyper
gagcgtcacagatgccgcccacgcccccccgcttttcggcccgg

SEQ ID NO: 7204 - DNA, 102 bp, Homo sapiens
  chr4:789169-789271
  hyper
gcatgagctgcatcccgcatccgcaggagggcggcgctgcgacccacccccgcccccgtttccagaggaggccgctgcggcgcggggcggtcccacgtggtg

SEQ ID NO: 7205 - DNA, 1 bp, Homo sapiens
  chr4:995993-995994
  hyper
c

SEQ ID NO: 7206 - DNA, 75 bp, Homo sapiens
  chr4:996100-996175
  hyper
cgccttcccctacgcgctcctgagcaacgacaatgccttcctgagctaccacccgcaccccttcgcgcagcgcac

SEQ ID NO: 7207 - DNA, 44 bp, Homo sapiens
  chr4:996495-996539
  hyper
cgacggcccccccccgccccgcagatgaggagcagctctgggcc

SEQ ID NO: 7208 - DNA, 21 bp, Homo sapiens
  chr4:1165449-1165470
  hyper
cgtgagcgccccctgccccca

SEQ ID NO: 7209 - DNA, 139 bp, Homo sapiens
  chr4:1166167-1166306
  hyper
acccggggccttggccgactggctgcccccgggactagacccttaaagctcggtcgcagccagtcctgggggtccctctggaggtgccacaaggttctgggccgcggggaaagtgcaggaggcccgggccctctctggg

SEQ ID NO: 7210 - DNA, 99 bp, Homo sapiens
  chr4:1397396-1397495
  hyper
cgcgggccccgaggccgccgccgcctccccgcgcctcctccgcgcctcgcgccgcctccgtctcgggcgcttcgtcctcgtcgtcgtcctcgtcgtcgg

SEQ ID NO: 7211 - DNA, 65 bp, Homo sapiens
  chr4:1398277-1398342
  hyper
gggtagggccctgctcggcctcaccaggagggctgggcgggcgtgcaggtcggagtggctccccg

SEQ ID NO: 7212 - DNA, 72 bp, Homo sapiens
  chr4:1399065-1399137
  hyper
aggtcgaatgcaattcgcgatcaatagcggcccctaataagtgtaataggttttaatcgagtaattatccga

SEQ ID NO: 7213 - DNA, 92 bp, Homo sapiens
  chr4:1400248-1400340
  hyper
cggcggctcgggccccgccacctactgggctcccatccctggcggcccccgcacctccacacgaccccgcgcaggcggccgctgctccgctc

SEQ ID NO: 7214 - DNA, 372 bp, Homo sapiens
  chr4:1401106-1401478
  hyper
cgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggatt

SEQ ID NO: 7215 - DNA, 141 bp, Homo sapiens
  chr4:1401683-1401824
  hyper
ccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagcc

SEQ ID NO: 7216 - DNA, 30 bp, Homo sapiens
  chr4:1404132-1404162
  hyper
acccatgttgatcaccggagtttgggaagt

SEQ ID NO: 7217 - DNA, 99 bp, Homo sapiens
  chr4:1404368-1404467
  hyper
gaacagcgccagcaccgcggacagcgcgctcccacctcgcccccggaggccacgggctcgggccgtgttcagcaccgcggacagcgccagcaactccga

SEQ ID NO: 7218 - DNA, 68 bp, Homo sapiens
  chr4:1408020-1408088
  hyper
gggagtcggggtgggcgcgtgtccgcgggagggagtcggggtgggcgcgtgtccgcgggagggagtcg

SEQ ID NO: 7219 - DNA, 42 bp, Homo sapiens
  chr4:1811789-1811831
  hyper
gcagagcatggggctcgaagcgcgggccgggagcgcccccta

SEQ ID NO: 7220 - DNA, 1 bp, Homo sapiens
  chr4:2042122-2042123
  hyper
g

SEQ ID NO: 7221 - DNA, 73 bp, Homo sapiens
  chr4:2042168-2042241
  hyper
cgagcgggcgcagcgtgggaccgaaggggagaaggacgcctgcggcccggcgcgtccccggaggcacgtcccc

SEQ ID NO: 7222 - DNA, 14 bp, Homo sapiens
  chr4:2042655-2042669
  hyper
gcagtcccagcttg

SEQ ID NO: 7223 - DNA, 43 bp, Homo sapiens
  chr4:2060112-2060155
  hyper
gcacaacgcagactgcgggtccccaggcctggacccctggccc

SEQ ID NO: 7224 - DNA, 41 bp, Homo sapiens
  chr4:2060173-2060214
  hyper
cggggaagctctgctccggcagccctcggggtggtgctggg

SEQ ID NO: 7225 - DNA, 82 bp, Homo sapiens
  chr4:2062004-2062086
  hyper
tgaggggaagacagccggcgccgcggggggtgcgcgcgcctggcacagccggggcggtcgcagagggcggccccttcagcgt

SEQ ID NO: 7226 - DNA, 174 bp, Homo sapiens
  chr4:2765778-2765952
  hyper
tggtatgggaccctccgggtgggcgcggccccgcggggccttgcggccacaccgccaccgtgcccagcggccccatcagcgcatattcaggatgaaccccggacacgcgcccagaaccgtctggtgacccagtgatgaaagctcgaatcttataggatccgtattcatttcccg

SEQ ID NO: 7227 - DNA, 42 bp, Homo sapiens
  chr4:2766173-2766215
  hyper
cactttgctccccagcgtgggcccctgagcgctgggggaagt

SEQ ID NO: 7228 - DNA, 30 bp, Homo sapiens
  chr4:3767309-3767339
  hyper
gcgcgcccccgcctgcgcccatgcctgcgc

SEQ ID NO: 7229 - DNA, 45 bp, Homo sapiens
  chr4:3767848-3767893
  hyper
ggcgccccggcgcgccgagccctagccggccggatgggaggcgga

SEQ ID NO: 7230 - DNA, 183 bp, Homo sapiens; identical to SEQ ID NO: 2361
  chr4:3769007-3769190
  hyper

SEQ ID NO: 7231 - DNA, 620 bp, Homo sapiens
  chr4:3873083-3873703
  hyper
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccat

SEQ ID NO: 7232 - DNA, 50 bp, Homo sapiens
  chr4:3882155-3882205
  hyper
tgcctgaggagggtccgcagaagttccctctcgagcgggaggaggggatt

SEQ ID NO: 7233 - DNA, 15 bp, Homo sapiens
  chr4:4145386-4145401
  hyper
cgggatgtggggcta

SEQ ID NO: 7234 - DNA, 84 bp, Homo sapiens
  chr4:4228084-4228168
  hyper
aggctgaagggaagacggcagcggtaggaagggcgcagagcagcctcaggatgcagccagcgggcgaggaggcggagacccgct

SEQ ID NO: 7235 - DNA, 87 bp, Homo sapiens
  chr4:4228188-4228275
  hyper
cgcgcagccagccggcacccgcgtgcgtgtccttgaggcggaagaggcggcggtgcgcggagctgcggcccacgtaccacagcatcc

SEQ ID NO: 7236 - DNA, 99 bp, Homo sapiens
  chr4:4229682-4229781
  hyper
ccccttccaaagccccggtgcccgcctggcacccgcctgctcccggaaggggactgagtctgccagggagccccgctcgggtgccgctaagtggaggtc

SEQ ID NO: 7237 - DNA, 54 bp, Homo sapiens
  chr4:4387592-4387646
  hyper
acggctgatggaaaacgccccggaccctccgtagtgccgcggggaagtccccgg

SEQ ID NO: 7238 - DNA, 578 bp, Homo sapiens
  chr4:4387927-4388505
  hyper
caccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 7239 - DNA, 50 bp, Homo sapiens
  chr4:4388506-4388556
  hyper
cagcccgcagccctcccgctccgggcgccctccgccgctccgagaccccc

SEQ ID NO: 7240 - DNA, 46 bp, Homo sapiens
  chr4:4388772-4388818
  hyper
gccgtggagcccaatcgttcgctccccttcccgggtccgcgcgcgg

SEQ ID NO: 7241 - DNA, 82 bp, Homo sapiens
  chr4:4854669-4854751
  hyper
ctctcctgcctgggccgacccggcgctttactgcttctcacgaaggtgcgccggctgctccagaaatcgcagactgcctcca

SEQ ID NO: 7242 - DNA, 238 bp, Homo sapiens
  chr4:4854954-4855192
  hyper
agagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtgggg

SEQ ID NO: 7243 - DNA, 44 bp, Homo sapiens
  chr4:4858727-4858771
  hyper
cacattgtttatccccgcaattagcgatgcggcccttttcaggc

SEQ ID NO: 7244 - DNA, 259 bp, Homo sapiens
  chr4:4862186-4862445
  hyper
ctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgt

SEQ ID NO: 7245 - DNA, 262 bp, Homo sapiens
  chr4:4862799-4863061
  hyper
tctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggc

SEQ ID NO: 7246 - DNA, 151 bp, Homo sapiens
  chr4:4867591-4867742
  hyper
agagcaacataattgcggtaatgagcaacggctcaccctctgcagacgcgtcgcggctccagcgaggcggtagctgcaggcgaggcgggcgcgcctccccgccccctccctgcgccgcagcccgggtgcgagggcccggcctccctgggac

SEQ ID NO: 7247 - DNA, 30 bp, Homo sapiens
  chr4:4868050-4868080
  hyper
ccctggtttatcaaccgagggcggagtggg

SEQ ID NO: 7248 - DNA, 238 bp, Homo sapiens; identical to SEQ ID NO: 2362
  chr4:4868555-4868793
  hyper

SEQ ID NO: 7249 - DNA, 172 bp, Homo sapiens; identical to SEQ ID NO: 2363
  chr4:4868828-4869000
  hyper

SEQ ID NO: 7250 - DNA, 127 bp, Homo sapiens; identical to SEQ ID NO: 2364
  chr4:4869131-4869258
  hyper

SEQ ID NO: 7251 - DNA, 30 bp, Homo sapiens
  chr4:4870173-4870203
  hyper
aatcgcctgagggaacgctgggagttcccc

SEQ ID NO: 7252 - DNA, 15 bp, Homo sapiens
  chr4:4872017-4872032
  hyper
gggtgagaaggggag

SEQ ID NO: 7253 - DNA, 77 bp, Homo sapiens
  chr4:4872059-4872136
  hyper
cggagcatagaggcaggatggtgacctgagcgctctttgctggccggctctgctctccgcagcgccattggaattcc

SEQ ID NO: 7254 - DNA, 1175 bp, Homo sapiens; identical to SEQ ID NO: 2365
  chr4:5052930-5054105
  hyper

SEQ ID NO: 7255 - DNA, 79 bp, Homo sapiens
  chr4:5709906-5709985
  hyper
cttcctcattctttgcgaaatactaagggtcctccctgccaccgccggtgtagacaaagtcaaaccactacagtcagac

SEQ ID NO: 7256 - DNA, 253 bp, Homo sapiens; identical to SEQ ID NO: 2366
  chr4:5712979-5713232
  hyper

SEQ ID NO: 7257 - DNA, 194 bp, Homo sapiens
  chr4:5889144-5889338
  hyper
aacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcggg

SEQ ID NO: 7258 - DNA, 784 bp, Homo sapiens
  chr4:5889545-5890329
  hyper
ggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggccgcttaccgtgatgtgcgggatgctcttcttgccctggtacgacatggccccctctggcgccctcggcccggccgctgacctgcggggctgtctgactggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctcccggcggcgcggagcgaagccggattcgcccctctcggctcgaaccaggaagcgc

SEQ ID NO: 7259 - DNA, 30 bp, Homo sapiens
  chr4:5890534-5890564
  hyper
tccccggaacatctgcgggggtgtgggggg

SEQ ID NO: 7260 - DNA, 116 bp, Homo sapiens; identical to SEQ ID NO: 2367
  chr4:5891966-5892082
  hyper

SEQ ID NO: 7261 - DNA, 56 bp, Homo sapiens; identical to SEQ ID NO: 2368
  chr4:5892109-5892165
  hyper

SEQ ID NO: 7262 - DNA, 234 bp, Homo sapiens
  chr4:5893517-5893751
  hyper
tcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcc

SEQ ID NO: 7263 - DNA, 52 bp, Homo sapiens
  chr4:5894812-5894864
  hyper
cggcccagggaggggaggggcggggcgtggcgcgcgccggggcggggccggg

SEQ ID NO: 7264 - DNA, 415 bp, Homo sapiens
  chr4:6200878-6201293
  hyper
aggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgc

SEQ ID NO: 7265 - DNA, 138 bp, Homo sapiens
  chr4:6201349-6201487
  hyper
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctcca

SEQ ID NO: 7266 - DNA, 645 bp, Homo sapiens; identical to SEQ ID NO: 2369
  chr4:6201895-6202540
  hyper

SEQ ID NO: 7267 - DNA, 366 bp, Homo sapiens
  chr4:6247351-6247717
  hyper
aaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 7268 - DNA, 30 bp, Homo sapiens
  chr4:6473934-6473964
  hyper
gcgtgtccgtgtcctcgcccattgaaggcc

SEQ ID NO: 7269 - DNA, 277 bp, Homo sapiens
  chr4:6473965-6474242
  hyper
tgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccgg

SEQ ID NO: 7270 - DNA, 45 bp, Homo sapiens
  chr4:6565004-6565049
  hyper
gttccctcaagaccccgagagcacgcgctccggagggaccccggc

SEQ ID NO: 7271 - DNA, 101 bp, Homo sapiens
  chr4:7194437-7194538
  hyper
ccggggctccgccgccgccgcgctcgccgcgctcgcggccgctcctgctgctgctgctgctgctgggcgcctgcggggcggcggggcgctcccctgagccc

SEQ ID NO: 7272 - DNA, 30 bp, Homo sapiens
  chr4:7195153-7195183
  hyper
ggaccccagaaccttcggaagcctgcaggt

SEQ ID NO: 7273 - DNA, 38 bp, Homo sapiens
  chr4:8271520-8271558
  hyper
tggggatgcccctgccgccctgacgcccgccagcctga

SEQ ID NO: 7274 - DNA, 290 bp, Homo sapiens; identical to SEQ ID NO: 350
  chr4:8858758-8859048
  hyper

SEQ ID NO: 7275 - DNA, 557 bp, Homo sapiens; identical to SEQ ID NO: 351
  chr4:8859381-8859938
  hyper

SEQ ID NO: 7276 - DNA, 30 bp, Homo sapiens
  chr4:8860523-8860553
  hyper
aaactctcggagcatcgtcactgggaggtc

SEQ ID NO: 7277 - DNA, 66 bp, Homo sapiens
  chr4:8861687-8861753
  hyper
ggaggcacaactgcccgtggtgggagtggagggcttaggtccccattagaaccggcagagccccga

SEQ ID NO: 7278 - DNA, 96 bp, Homo sapiens
  chr4:8861918-8862014
  hyper
cgccaaatggaagtgggggcgccccctggcctttcctatacccggggccaaaaccgctgggaccgatatactgcaggagtccgggcacaggctgag

SEQ ID NO: 7279 - DNA, 408 bp, Homo sapiens
  chr4:8862404-8862812
  hyper
ccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 7280 - DNA, 155 bp, Homo sapiens
  chr4:8863372-8863527
  hyper
cgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 7281 - DNA, 55 bp, Homo sapiens
  chr4:8864543-8864598
  hyper
gtgaggctggctcttcgaccacttagctgttctcggcgcccgatcctgtgtgtcc

SEQ ID NO: 7282 - DNA, 106 bp, Homo sapiens
  chr4:8868710-8868816
  hyper
agggacggcacccagcgcagcttgagctgtctctgccctcgtgatcacaaagcagtgaaactgtccagaaaatgtccctttttattccatacgcaaataagtagat

SEQ ID NO: 7283 - DNA, 156 bp, Homo sapiens; identical to SEQ ID NO: 352
  chr4:8869115-8869271
  hyper

SEQ ID NO: 7284 - DNA, 445 bp, Homo sapiens; identical to SEQ ID NO: 353
  chr4:8869368-8869813
  hyper

SEQ ID NO: 7285 - DNA, 30 bp, Homo sapiens
  chr4:8872946-8872976
  hyper
tgtcaggactgaggccgcctccatagccac

SEQ ID NO: 7286 - DNA, 211 bp, Homo sapiens
  chr4:8873773-8873984
  hyper
gggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgt

SEQ ID NO: 7287 - DNA, 59 bp, Homo sapiens
  chr4:8874476-8874535
  hyper
ctcccatatctgcagcgggaagttcgggaacataacgcaccctggagctgtctccgttc

SEQ ID NO: 7288 - DNA, 124 bp, Homo sapiens
  chr4:8875773-8875897
  hyper
ggtggtggccctgagcgcataacgctcgcgggtgtcttcccactgcctctggggggcgcgcatgagaggggcgcttccacacactgccgcgtggggcctgggatgggagcgaagaggggcggtg

SEQ ID NO: 7289 - DNA, 76 bp, Homo sapiens
  chr4:8878569-8878645
  hyper
ttagtctgatccccacgtcgcagccagcaggaaatgtccttgcagctgtggagatgtggatcggaactagggcacc

SEQ ID NO: 7290 - DNA, 60 bp, Homo sapiens
  chr4:8879491-8879551
  hyper
cctggagcctggaaccgccggggccagctgagaagccgcctccgccgctggagtccctgg

SEQ ID NO: 7291 - DNA, 41 bp, Homo sapiens
  chr4:8893958-8893999
  hyper
gggttgcatgggacccgcggttaccccgcaaacacagacgc

SEQ ID NO: 7292 - DNA, 116 bp, Homo sapiens; identical to SEQ ID NO: 2374
  chr4:8894842-8894958
  hyper

SEQ ID NO: 7293 - DNA, 134 bp, Homo sapiens; identical to SEQ ID NO: 2375
  chr4:8895964-8896098
  hyper

SEQ ID NO: 7294 - DNA, 205 bp, Homo sapiens; identical to SEQ ID NO: 2376
  chr4:8896117-8896322
  hyper

SEQ ID NO: 7295 - DNA, 139 bp, Homo sapiens
  chr4:9783202-9783341
  hyper
gctcggggggcgggacgcggggcctgggagcggccagggaccgcggcagcgcctcagtgccagcctggcgcccgcgactgcctgccccagcccctcagtggcggcttgctctcttctctcgctccgaaccagacacagc

SEQ ID NO: 7296 - DNA, 726 bp, Homo sapiens; identical to SEQ ID NO: 2377
  chr4:10458395-10459121
  hyper

SEQ ID NO: 7297 - DNA, 273 bp, Homo sapiens; identical to SEQ ID NO: 354
  chr4:10462775-10463048
  hyper

SEQ ID NO: 7298 - DNA, 184 bp, Homo sapiens; identical to SEQ ID NO: 355
  chr4:10463072-10463256
  hyper

SEQ ID NO: 7299 - DNA, 280 bp, Homo sapiens; identical to SEQ ID NO: 356
  chr4:10463257-10463537
  hyper

SEQ ID NO: 7300 - DNA, 51 bp, Homo sapiens
  chr4:11429636-11429687
  hyper
tccctcacctccatccgctgccactacccaagggcccggaaatagaaaacc

SEQ ID NO: 7301 - DNA, 30 bp, Homo sapiens
  chr4:13523948-13523978
  hyper
tccctaccttcctcccgagggagaggcaga

SEQ ID NO: 7302 - DNA, 64 bp, Homo sapiens
  chr4:13524188-13524252
  hyper
tccgcaagaagaaggcggcctccgggtgtcggccgcagccaggctactgtgctccggggcaaac

SEQ ID NO: 7303 - DNA, 69 bp, Homo sapiens
  chr4:13537673-13537742
  hyper
cggcaccagggactgcgagcaggggcatggagtgggagggaaagctgaggagagcgggctttgagcctg

SEQ ID NO: 7304 - DNA, 83 bp, Homo sapiens; identical to SEQ ID NO: 357
  chr4:13545940-13546023
  hyper

SEQ ID NO: 7305 - DNA, 86 bp, Homo sapiens
  chr4:13546466-13546552
  hyper
tcgcctgcaggatttcgctcctggcccgtcctccccttccctgctgggcaggctcttccggagcccacccccggcggcggcggcgg

SEQ ID NO: 7306 - DNA, 35 bp, Homo sapiens; identical to SEQ ID NO: 358
  chr4:13548555-13548590
  hyper

SEQ ID NO: 7307 - DNA, 328 bp, Homo sapiens; identical to SEQ ID NO: 359
  chr4:13548634-13548962
  hyper

SEQ ID NO: 7308 - DNA, 30 bp, Homo sapiens
  chr4:13549282-13549312
  hyper
ttcggtccccggaaccgcccgggctggggg

SEQ ID NO: 7309 - DNA, 89 bp, Homo sapiens
  chr4:13549546-13549635
  hyper
ccagcggccggaggtcgcgcgcgccgggtgctgcccagcaacgaaaggccatgcggggttcgtccctcagatgccggtgaccttgattg

SEQ ID NO: 7310 - DNA, 145 bp, Homo sapiens
  chr4:15780307-15780452
  hyper
gggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcag

SEQ ID NO: 7311 - DNA, 30 bp, Homo sapiens
  chr4:16083935-16083965
  hyper
cccaacatatcgcagcggttgttcgtgtcg

SEQ ID NO: 7312 - DNA, 60 bp, Homo sapiens
  chr4:16084408-16084468
  hyper
ttcctccctccgatccgactccctgcccctccagacacgggctttcggggaaactgatcc

SEQ ID NO: 7313 - DNA, 78 bp, Homo sapiens; identical to SEQ ID NO: 2384
  chr4:16084741-16084819
  hyper

SEQ ID NO: 7314 - DNA, 14 bp, Homo sapiens
  chr4:16085166-16085180
  hyper
cgcagagcgaaccc

SEQ ID NO: 7315 - DNA, 121 bp, Homo sapiens; identical to SEQ ID NO: 2386
  chr4:16085181-16085302
  hyper

SEQ ID NO: 7316 - DNA, 48 bp, Homo sapiens; identical to SEQ ID NO: 2387
  chr4:16085351-16085399
  hyper

SEQ ID NO: 7317 - DNA, 26 bp, Homo sapiens
  chr4:16085674-16085700
  hyper
cgagccctggacgcactctgattgga

SEQ ID NO: 7318 - DNA, 291 bp, Homo sapiens; identical to SEQ ID NO: 2388
  chr4:17783003-17783294
  hyper

SEQ ID NO: 7319 - DNA, 27 bp, Homo sapiens
  chr4:17783295-17783322
  hyper
gtgggcgggcactgcgctcttggacac

SEQ ID NO: 7320 - DNA, 158 bp, Homo sapiens; identical to SEQ ID NO: 2390
  chr4:17783323-17783481
  hyper

SEQ ID NO: 7321 - DNA, 30 bp, Homo sapiens
  chr4:20253853-20253883
  hyper
ttccttccagacaagcgagacttgggctgc

SEQ ID NO: 7322 - DNA, 40 bp, Homo sapiens
  chr4:20254263-20254303
  hyper
ccatcaggtgtctgccgcggagctgcggcttatctgggag

SEQ ID NO: 7323 - DNA, 51 bp, Homo sapiens
  chr4:20255045-20255096
  hyper
cctccccacaacaaccggcccctgcatcttagcagccgttggaagccccag

SEQ ID NO: 7324 - DNA, 675 bp, Homo sapiens
  chr4:20255611-20256286
  hyper
gagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcag

SEQ ID NO: 7325 - DNA, 28 bp, Homo sapiens
  chr4:20256841-20256869
  hyper
gctctgacccgcacgtctccacccgcgc

SEQ ID NO: 7326 - DNA, 48 bp, Homo sapiens
  chr4:21950248-21950296
  hyper
attcatgtctagggacgcagggtgcagaagcgagactcgagagtccac

SEQ ID NO: 7327 - DNA, 122 bp, Homo sapiens
  chr4:30720054-30720176
  hyper
cgctacatctgctcgttgactttattggtgtttgtcttgtttaaatcattctgcctcgtcacccaggtctcgtaaagaatacccacactggacagattttattttttcggctttaaattttt

SEQ ID NO: 7328 - DNA, 161 bp, Homo sapiens
  chr4:30724292-30724453
  hyper
atccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagct

SEQ ID NO: 7329 - DNA, 45 bp, Homo sapiens; identical to SEQ ID NO: 2391
  chr4:37245537-37245582
  hyper

SEQ ID NO: 7330 - DNA, 525 bp, Homo sapiens; identical to SEQ ID NO: 2392
  chr4:37245836-37246361
  hyper

SEQ ID NO: 7331 - DNA, 211 bp, Homo sapiens; identical to SEQ ID NO: 2393
  chr4:37246489-37246700
  hyper

SEQ ID NO: 7332 - DNA, 111 bp, Homo sapiens; identical to SEQ ID NO: 2394
  chr4:37247015-37247126
  hyper

SEQ ID NO: 7333 - DNA, 37 bp, Homo sapiens
  chr4:37247355-37247392
  hyper
cagacttttgtgaaccggaggtcgagggggacaccct

SEQ ID NO: 7334 - DNA, 80 bp, Homo sapiens
  chr4:39047287-39047367
  hyper
gggatcagaagctggcggtaaaagtttgctatgtcagagagtaaagcgttactgtcgttttttatcgcttcatttcattt

SEQ ID NO: 7335 - DNA, 73 bp, Homo sapiens; identical to SEQ ID NO: 360
  chr4:41258716-41258789
  hyper

SEQ ID NO: 7336 - DNA, 381 bp, Homo sapiens; identical to SEQ ID NO: 361
  chr4:41259085-41259466
  hyper

SEQ ID NO: 7337 - DNA, 403 bp, Homo sapiens
  chr4:41746833-41747236
  hyper
tgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 7338 - DNA, 124 bp, Homo sapiens
  chr4:41747888-41748012
  hyper
cgctggcgaagggacccccaagcgaatccgggatggaggtgatggggccggggccgggagcccagccttgtccagggcccccagccgcagccaggcctccagctgccgccgctgccgctgccgc

SEQ ID NO: 7339 - DNA, 194 bp, Homo sapiens
  chr4:41748143-41748337
  hyper
cgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccac

SEQ ID NO: 7340 - DNA, 266 bp, Homo sapiens
  chr4:41749474-41749740
  hyper
ctggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctc

SEQ ID NO: 7341 - DNA, 333 bp, Homo sapiens; identical to SEQ ID NO: 362
  chr4:41750266-41750599
  hyper

SEQ ID NO: 7342 - DNA, 30 bp, Homo sapiens
  chr4:41751870-41751900
  hyper
gcaagggctccaggtcgggcacctttcttg

SEQ ID NO: 7343 - DNA, 758 bp, Homo sapiens; identical to SEQ ID NO: 2398
  chr4:41752954-41753712
  hyper

SEQ ID NO: 7344 - DNA, 90 bp, Homo sapiens; identical to SEQ ID NO: 2399
  chr4:41753713-41753803
  hyper

SEQ ID NO: 7345 - DNA, 113 bp, Homo sapiens; identical to SEQ ID NO: 2400
  chr4:41753804-41753917
  hyper

SEQ ID NO: 7346 - DNA, 41 bp, Homo sapiens; identical to SEQ ID NO: 2401
  chr4:41754030-41754071
  hyper

SEQ ID NO: 7347 - DNA, 32 bp, Homo sapiens
  chr4:41867804-41867836
  hyper
caataaaggagagcgcgcggaaatgggacttc

SEQ ID NO: 7348 - DNA, 341 bp, Homo sapiens; identical to SEQ ID NO: 363
  chr4:41875410-41875751
  hyper

SEQ ID NO: 7349 - DNA, 46 bp, Homo sapiens; identical to SEQ ID NO: 2403
  chr4:41881385-41881431
  hyper

SEQ ID NO: 7350 - DNA, 689 bp, Homo sapiens; identical to SEQ ID NO: 364
  chr4:41882935-41883624
  hyper

SEQ ID NO: 7351 - DNA, 60 bp, Homo sapiens
  chr4:41883886-41883946
  hyper
ccccggagaccccaccgagcccagcgcccgcccccgccccctgggcgccctgccccattt

SEQ ID NO: 7352 - DNA, 82 bp, Homo sapiens
  chr4:41884164-41884246
  hyper
cccctcccccacccccggaggcgggtgcagtgcagggcgggggcggcggtcgcagcggctcagaagccgaccctccttgaac

SEQ ID NO: 7353 - DNA, 451 bp, Homo sapiens; identical to SEQ ID NO: 365
  chr4:42152961-42153412
  hyper

SEQ ID NO: 7354 - DNA, 101 bp, Homo sapiens; identical to SEQ ID NO: 366
  chr4:42153532-42153633
  hyper

SEQ ID NO: 7355 - DNA, 504 bp, Homo sapiens; identical to SEQ ID NO: 367
  chr4:42153881-42154385
  hyper

SEQ ID NO: 7356 - DNA, 611 bp, Homo sapiens; identical to SEQ ID NO: 368
  chr4:42154386-42154997
  hyper

SEQ ID NO: 7357 - DNA, 346 bp, Homo sapiens
  chr4:42399099-42399445
  hyper
cttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaa

SEQ ID NO: 7358 - DNA, 743 bp, Homo sapiens
  chr4:42399735-42400478
  hyper
tggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcg

SEQ ID NO: 7359 - DNA, 147 bp, Homo sapiens
  chr4:42400901-42401048
  hyper
ttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtc

SEQ ID NO: 7360 - DNA, 30 bp, Homo sapiens
  chr4:44449013-44449043
  hyper
tgggggcacctttatcgcttctcccctgcc

SEQ ID NO: 7361 - DNA, 27 bp, Homo sapiens
  chr4:44449652-44449679
  hyper
cgaggagttacacgccaccatgtggaa

SEQ ID NO: 7362 - DNA, 127 bp, Homo sapiens; identical to SEQ ID NO: 2409
  chr4:44450050-44450177
  hyper

SEQ ID NO: 7363 - DNA, 223 bp, Homo sapiens; identical to SEQ ID NO: 2410
  chr4:44450741-44450964
  hyper

SEQ ID NO: 7364 - DNA, 660 bp, Homo sapiens; identical to SEQ ID NO: 2411
  chr4:46995161-46995821
  hyper

SEQ ID NO: 7365 - DNA, 567 bp, Homo sapiens; identical to SEQ ID NO: 2412
  chr4:46995822-46996389
  hyper

SEQ ID NO: 7366 - DNA, 341 bp, Homo sapiens
  chr4:47034412-47034753
  hyper
tgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 7367 - DNA, 184 bp, Homo sapiens
  chr4:47034754-47034938
  hyper
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcc

SEQ ID NO: 7368 - DNA, 16 bp, Homo sapiens
  chr4:48485273-48485289
  hyper
ttcacaggaggggacc

SEQ ID NO: 7369 - DNA, 216 bp, Homo sapiens; identical to SEQ ID NO: 2414
  chr4:48485589-48485805
  hyper

SEQ ID NO: 7370 - DNA, 114 bp, Homo sapiens
  chr4:48987949-48988063
  hyper
cctcgcagagcaccccgtgggcctagtctaaacgagggcaccactggtccggagttgcacttgttcgctccctcctgggctctggcagcgctgcatccccggggttgcttcggg

SEQ ID NO: 7371 - DNA, 30 bp, Homo sapiens
  chr4:48988465-48988495
  hyper
aaatcctcttggagtcgctgctgggtaagc

SEQ ID NO: 7372 - DNA, 88 bp, Homo sapiens
  chr4:53617427-53617515
  hyper
aagctcgaggggacacggggcgagcccagaccctgcctgggagccctccccgccggagaccaaagggcagaaacgcactcacagtgca

SEQ ID NO: 7373 - DNA, 30 bp, Homo sapiens
  chr4:53728192-53728222
  hyper
ctctcttcctggccccgcagccacagcagc

SEQ ID NO: 7374 - DNA, 112 bp, Homo sapiens
  chr4:53728705-53728817
  hyper
ccgagtaccccgcgccgggcaacgccgcggcctccgactgctgtgtgggcgccgccggccgccgcctggtcaagatcgccgtggtgggcgccagcggcgtgggcaagaccgg

SEQ ID NO: 7375 - DNA, 78 bp, Homo sapiens
  chr4:54965843-54965921
  hyper
cgactgccagtccgtcgcccgcacaatcctgctccaaaccgcaggcctcacacttcaccgcgccgcagccacccctac

SEQ ID NO: 7376 - DNA, 450 bp, Homo sapiens
  chr4:54966521-54966971
  hyper
ccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcag

SEQ ID NO: 7377 - DNA, 162 bp, Homo sapiens; identical to SEQ ID NO: 2415
  chr4:54967330-54967492
  hyper

SEQ ID NO: 7378 - DNA, 682 bp, Homo sapiens
  chr4:54969833-54970515
  hyper
aggaaaatccctcttcgttccgtcaagggacatagggaggagggcccgcactgtgtgaggctgaaaagggagctgccggcgctttgtgcaatgtgctgagctctgtcctgcgcagaggtcccagacagccggctcactactgcctggcctgggaagctcaggcctctggatctctttcctcctgtctctcacgcgcagagctccgggctcttcgccctgcccgccacgaaagggaggaggcgcaggccggctgcctttccaaaagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctatgtccatgactagccccgatcacagtctcttaagcctctcccggcccccggctcccaggccctgcggagccaagcacttggaacaccaggtaccgcgcgcggtggacccagctctgccatgccgcagatagccgcagtgccaaccct

SEQ ID NO: 7379 - DNA, 130 bp, Homo sapiens; identical to SEQ ID NO: 369
  chr4:54975802-54975932
  hyper

SEQ ID NO: 7380 - DNA, 126 bp, Homo sapiens; identical to SEQ ID NO: 370
  chr4:54975990-54976116
  hyper

SEQ ID NO: 7381 - DNA, 30 bp, Homo sapiens
  chr4:55093200-55093230
  hyper
gtttaaggaaccaaccgcctcggttcgagg

SEQ ID NO: 7382 - DNA, 15 bp, Homo sapiens
  chr4:55093818-55093833
  hyper
ttttgccttttattc

SEQ ID NO: 7383 - DNA, 123 bp, Homo sapiens
  chr4:55093888-55094011
  hyper
cggtatcctgttagcattccgaacaaggggctgttcatatatttgccttcaatgatttcctgaagggacatgtggaagtaatagcgagcggtgcagtcacccaagctgaagatgcacgagagc

SEQ ID NO: 7384 - DNA, 63 bp, Homo sapiens
  chr4:55094012-55094075
  hyper
ggtcgcgtagaagaactgcggcaatgggacccccagcgcagccccaggcgccctgttttcgag

SEQ ID NO: 7385 - DNA, 33 bp, Homo sapiens
  chr4:55096239-55096272
  hyper
cgcgtgattactggacggcgctgctctgggaga

SEQ ID NO: 7386 - DNA, 72 bp, Homo sapiens
  chr4:55096538-55096610
  hyper
ggatttgaggaatttcgaaccgcacaccaaggggccctcattgtgctccgtggcccccgcccccgcctgtct

SEQ ID NO: 7387 - DNA, 30 bp, Homo sapiens
  chr4:55097411-55097441
  hyper
gtccctaccgccccgcgtccgaaaagccgc

SEQ ID NO: 7388 - DNA, 107 bp, Homo sapiens
  chr4:55098637-55098744
  hyper
cctactgcagtttctcggcccccgcgaaaggggagcgacaagcgcgggtgggcgcggactcttgagggggcagaggcggctatggcgcgtgtcgggcaaggtggcac

SEQ ID NO: 7389 - DNA, 131 bp, Homo sapiens
  chr4:55099042-55099173
  hyper
gcgcccggccaggaacggttcttaaatgccgagagggcgcatgctagctctcctcagcattcccggtgagccgctacccacggccgtgcggctctcgtgcccataggaggcgctggcgagctcctgtaacc

SEQ ID NO: 7390 - DNA, 62 bp, Homo sapiens
  chr4:55523652-55523714
  hyper
cacctccacgagcagcggcgtccagcctcctcccgcccgaacgtgctcgaggggcgggcagt

SEQ ID NO: 7391 - DNA, 30 bp, Homo sapiens
  chr4:55991067-55991097
  hyper
cctgccaaccccaggcgccttcccacccca

SEQ ID NO: 7392 - DNA, 30 bp, Homo sapiens
  chr4:56501660-56501690
  hyper
ctagtgcctgaaaaccgataaggcacaaag

SEQ ID NO: 7393 - DNA, 50 bp, Homo sapiens
  chr4:56659934-56659984
  hyper
cgcactccccgggtatgctgcgggccctctccatccggggaggcggggtc

SEQ ID NO: 7394 - DNA, 16 bp, Homo sapiens
  chr4:57371852-57371868
  hyper
ccgcgaggtaagcggc

SEQ ID NO: 7395 - DNA, 145 bp, Homo sapiens
  chr4:57371869-57372014
  hyper
gttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaa

SEQ ID NO: 7396 - DNA, 171 bp, Homo sapiens
  chr4:57396480-57396651
  hyper
acagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtggga

SEQ ID NO: 7397 - DNA, 110 bp, Homo sapiens
  chr4:57397172-57397282
  hyper
aaactcctcaaggcccgtgaaccccgccagctccgccacacccgtgagccccgcaagtcccgcgaggccaaggaaaccgagttgcttcccagcgccgcagtaatgatctc

SEQ ID NO: 7398 - DNA, 1 bp, Homo sapiens
  chr4:57521395-57521396
  hyper
t

SEQ ID NO: 7399 - DNA, 159 bp, Homo sapiens; identical to SEQ ID NO: 372
  chr4:57521505-57521664
  hyper

SEQ ID NO: 7400 - DNA, 683 bp, Homo sapiens; identical to SEQ ID NO: 373
  chr4:57521700-57522383
  hyper

SEQ ID NO: 7401 - DNA, 396 bp, Homo sapiens; identical to SEQ ID NO: 374
  chr4:57522419-57522815
  hyper

SEQ ID NO: 7402 - DNA, 50 bp, Homo sapiens
  chr4:57687669-57687719
  hyper
gtcgccgaggccgcccggagcagggcagggtccgccgccggtctgactcc

SEQ ID NO: 7403 - DNA, 30 bp, Homo sapiens
  chr4:57976081-57976111
  hyper
tctccccgcggctctcggccctctggctgg

SEQ ID NO: 7404 - DNA, 264 bp, Homo sapiens
  chr4:57976405-57976669
  hyper
ccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggcccc

SEQ ID NO: 7405 - DNA, 30 bp, Homo sapiens
  chr4:57977077-57977107
  hyper
actaaaaggacaaaccgttgccaaccactt

SEQ ID NO: 7406 - DNA, 18 bp, Homo sapiens
  chr4:62065800-62065818
  hyper
cgccgaggcgggcctcga

SEQ ID NO: 7407 - DNA, 30 bp, Homo sapiens
  chr4:62066303-62066333
  hyper
ccgccgcctgtgactcgccccctccccttt

SEQ ID NO: 7408 - DNA, 290 bp, Homo sapiens
  chr4:62066913-62067203
  hyper
actggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcga

SEQ ID NO: 7409 - DNA, 184 bp, Homo sapiens; identical to SEQ ID NO: 2422
  chr4:62067440-62067624
  hyper

SEQ ID NO: 7410 - DNA, 30 bp, Homo sapiens
  chr4:66535107-66535137
  hyper
aaccgcagaggggagcgaaaaggccagtgg

SEQ ID NO: 7411 - DNA, 108 bp, Homo sapiens
  chr4:71600516-71600624
  hyper
atactcttgcactagcgttggcttcagtgcactgtcattaaccacagtgccttacagtattttcttctattggtgagccttttctggacctttcgtgaaacagagctt

SEQ ID NO: 7412 - DNA, 39 bp, Homo sapiens
  chr4:73434048-73434087
  hyper
agaacttcattcaagcgcccagaccgccctccagaaagg

SEQ ID NO: 7413 - DNA, 252 bp, Homo sapiens
  chr4:73434964-73435216
  hyper
acgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggt

SEQ ID NO: 7414 - DNA, 42 bp, Homo sapiens
  chr4:75231005-75231047
  hyper
agcgcccgctcccatcgccgatgaccgcggggaggaggatgg

SEQ ID NO: 7415 - DNA, 45 bp, Homo sapiens
  chr4:76555668-76555713
  hyper
ccaactacccctgggcgaaggcgttggccgcggagctgcaagggg

SEQ ID NO: 7416 - DNA, 218 bp, Homo sapiens; identical to SEQ ID NO: 2423
  chr4:81106163-81106381
  hyper

SEQ ID NO: 7417 - DNA, 92 bp, Homo sapiens
  chr4:81123206-81123298
  hyper
gggcaccaaggaccacgggggcggcggcggcggtggcaaagaccagcagcagcagcagcaggaggcacctttaggcccgggtcccaagtttt

SEQ ID NO: 7418 - DNA, 279 bp, Homo sapiens; identical to SEQ ID NO: 2424
  chr4:81123625-81123904
  hyper

SEQ ID NO: 7419 - DNA, 347 bp, Homo sapiens; identical to SEQ ID NO: 2425
  chr4:81124121-81124468
  hyper

SEQ ID NO: 7420 - DNA, 36 bp, Homo sapiens
  chr4:81124695-81124731
  hyper
gaccccagctttccacgcgcgcgcaagcacagttaa

SEQ ID NO: 7421 - DNA, 363 bp, Homo sapiens
  chr4:81187040-81187403
  hyper
cgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcaca

SEQ ID NO: 7422 - DNA, 16 bp, Homo sapiens
  chr4:81187782-81187798
  hyper
gcgttataaatatccc

SEQ ID NO: 7423 - DNA, 271 bp, Homo sapiens
  chr4:81187799-81188070
  hyper
gtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggca

SEQ ID NO: 7424 - DNA, 40 bp, Homo sapiens
  chr4:81188276-81188316
  hyper
atctgcagatctacccggatggcaaagtcaatggatccca

SEQ ID NO: 7425 - DNA, 143 bp, Homo sapiens
  chr4:81188384-81188527
  hyper
cgggagggacagcaggtattcgccgggacacaggctcaccttcctgagcccaggccactgggaccaagctgatactcagaaacagccgggcgggttgggtggagatgcatctatatggcgtgcgcacacgcacccctctcctg

SEQ ID NO: 7426 - DNA, 37 bp, Homo sapiens
  chr4:81189854-81189891
  hyper
tgattcagcagcctgcggcgcacgtggtgagggcgcc

SEQ ID NO: 7427 - DNA, 214 bp, Homo sapiens
  chr4:81257025-81257239
  hyper
acctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 7428 - DNA, 65 bp, Homo sapiens; identical to SEQ ID NO: 2426
  chr4:81951421-81951486
  hyper

SEQ ID NO: 7429 - DNA, 17 bp, Homo sapiens
  chr4:81951832-81951849
  hyper
agatcagctagagagcg

SEQ ID NO: 7430 - DNA, 137 bp, Homo sapiens
  chr4:81951909-81952046
  hyper
cgcacacacacacacacgtacactaaaaaactcggaccagccgcgccgcagctgctccaatccctggaaaaggcaatcgagcgccctccggaccgctgcgcacagccccggctccgacctggcgcccaaaacagagc

SEQ ID NO: 7431 - DNA, 43 bp, Homo sapiens
  chr4:81952269-81952312
  hyper
gcaagtggggctggccgctatctcgctgcacccggccgcgtcc

SEQ ID NO: 7432 - DNA, 157 bp, Homo sapiens
  chr4:81952727-81952884
  hyper
ttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctg

SEQ ID NO: 7433 - DNA, 123 bp, Homo sapiens
  chr4:82136082-82136205
  hyper
acctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 7434 - DNA, 37 bp, Homo sapiens
  chr4:82136243-82136280
  hyper
cgcagcgtgggcccggggctgccggctcagtcgctcc

SEQ ID NO: 7435 - DNA, 286 bp, Homo sapiens
  chr4:82136635-82136921
  hyper
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggc

SEQ ID NO: 7436 - DNA, 659 bp, Homo sapiens; identical to SEQ ID NO: 2427
  chr4:85402764-85403423
  hyper

SEQ ID NO: 7437 - DNA, 30 bp, Homo sapiens; identical to SEQ ID NO: 375
  chr4:85404111-85404141
  hyper

SEQ ID NO: 7438 - DNA, 252 bp, Homo sapiens; identical to SEQ ID NO: 376
  chr4:85404224-85404476
  hyper

SEQ ID NO: 7439 - DNA, 44 bp, Homo sapiens; identical to SEQ ID NO: 377
  chr4:85404649-85404693
  hyper

SEQ ID NO: 7440 - DNA, 189 bp, Homo sapiens
  chr4:85414148-85414337
  hyper
cggctgggaccgtggcccggctgcgggtttcagtagcgacatttacgcagtgcatttggtggtctttcttgccttatcaaccccggagtctctctcccctacatcccctcccacaacttcaaggttaaaaaaatagatatgtacatctcaaaaatagcaaagggtccccgcaggcagggccgggtcctc

SEQ ID NO: 7441 - DNA, 25 bp, Homo sapiens
  chr4:85414457-85414482
  hyper
ggctcggacgcgtgcagtaggaggc

SEQ ID NO: 7442 - DNA, 121 bp, Homo sapiens; identical to SEQ ID NO: 2431
  chr4:85414725-85414846
  hyper

SEQ ID NO: 7443 - DNA, 431 bp, Homo sapiens
  chr4:85416935-85417366
  hyper
ggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctcgcctcctaatccagtcggtgctcgttcggc

SEQ ID NO: 7444 - DNA, 53 bp, Homo sapiens
  chr4:85417666-85417719
  hyper
tcccgcagttactgccgctcagccgcactaaggaggtccggagacttggaaga

SEQ ID NO: 7445 - DNA, 87 bp, Homo sapiens
  chr4:85417972-85418059
  hyper
gtccccaaatgtgcccggacgcagcgtgtgccagcccccagagtggaggcaggtgggaaagcgcgggcccagcgctggtgagcggct

SEQ ID NO: 7446 - DNA, 37 bp, Homo sapiens
  chr4:85418265-85418302
  hyper
gaaggcggaatggggcgctggacgacagggaggagcc

SEQ ID NO: 7447 - DNA, 123 bp, Homo sapiens; identical to SEQ ID NO: 378
  chr4:85419120-85419243
  hyper

SEQ ID NO: 7448 - DNA, 87 bp, Homo sapiens
  chr4:85419695-85419782
  hyper
tagctgttcaaagtgcgctacttctcatcttctgcccccgggaaataagcaaaacaaaacccaggctggctccggagagtttgtagc

SEQ ID NO: 7449 - DNA, 262 bp, Homo sapiens; identical to SEQ ID NO: 2433
  chr4:85422188-85422450
  hyper

SEQ ID NO: 7450 - DNA, 30 bp, Homo sapiens
  chr4:85424453-85424483
  hyper
tagagtcgcagaatacgtacctgggagtta

SEQ ID NO: 7451 - DNA, 86 bp, Homo sapiens
  chr4:87281209-87281295
  hyper
acctaccagaggagacggacagagggcttggggaatggggttgctatggcaaccgaaaggagcacacatgacgtcaaagcccagag

SEQ ID NO: 7452 - DNA, 75 bp, Homo sapiens
  chr4:87515552-87515627
  hyper
cgtagctccccggtccgcctcggcagcggtcagagtcgcctacaggagttgagccgcccgcgccagaaggttttg

SEQ ID NO: 7453 - DNA, 136 bp, Homo sapiens
  chr4:89378373-89378509
  hyper
ggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccggg

SEQ ID NO: 7454 - DNA, 152 bp, Homo sapiens
  chr4:90757517-90757669
  hyper
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagccta

SEQ ID NO: 7455 - DNA, 122 bp, Homo sapiens
  chr4:90758478-90758600
  hyper
gccatcaactccagccgcctgcctggccgcgcaaggcgggaaagtgggggcgcttttgcgcctcacgttaagtttagggtcacgagcactcttgtggagatcgggagcggttgggctaggga

SEQ ID NO: 7456 - DNA, 40 bp, Homo sapiens; identical to SEQ ID NO: 2434
  chr4:90758843-90758883
  hyper

SEQ ID NO: 7457 - DNA, 30 bp, Homo sapiens
  chr4:90759319-90759349
  hyper
cccccacccaccacacgcacatgcacacag

SEQ ID NO: 7458 - DNA, 30 bp, Homo sapiens
  chr4:93225390-93225420
  hyper
ggaagggggcacatccggcgtgaggggggt

SEQ ID NO: 7459 - DNA, 30 bp, Homo sapiens
  chr4:93226479-93226509
  hyper
gtgtagtctttgagacggtggcaggagggg

SEQ ID NO: 7460 - DNA, 133 bp, Homo sapiens; identical to SEQ ID NO: 2435
  chr4:94750906-94751039
  hyper

SEQ ID NO: 7461 - DNA, 231 bp, Homo sapiens
  chr4:94751368-94751599
  hyper
aaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 7462 - DNA, 114 bp, Homo sapiens
  chr4:94753279-94753393
  hyper
taatgcactagggagcgcaggttctggtctccttaagtaagaaactgcagaaccagctttttactgaccacctgggtatctgtggctttcagcggaagccgaccaagagatgca

SEQ ID NO: 7463 - DNA, 30 bp, Homo sapiens
  chr4:94756066-94756096
  hyper
gcaaccagcccagcacgcaaagaagctgcg

SEQ ID NO: 7464 - DNA, 55 bp, Homo sapiens
  chr4:95678866-95678921
  hyper
gtcggctccgcactccgcacacaggcggcggcgctggggccgctccaagtgcgtt

SEQ ID NO: 7465 - DNA, 30 bp, Homo sapiens
  chr4:95679715-95679745
  hyper
ggcacccacctgccccggacgcctcccgag

SEQ ID NO: 7466 - DNA, 30 bp, Homo sapiens
  chr4:96469039-96469069
  hyper
ttcccaacccggcttcgcccagggccccgg

SEQ ID NO: 7467 - DNA, 221 bp, Homo sapiens; identical to SEQ ID NO: 2436
  chr4:101111366-101111587
  hyper

SEQ ID NO: 7468 - DNA, 46 bp, Homo sapiens
  chr4:101111826-101111872
  hyper
ttccagggtagatctcgggccactgggaccgcaattccgggtgcac

SEQ ID NO: 7469 - DNA, 68 bp, Homo sapiens
  chr4:101111873-101111941
  hyper
actcgtcaaagcctgaacctgattgttcagtgcgacccctccccgagcgtccgcgctttcacactcag

SEQ ID NO: 7470 - DNA, 365 bp, Homo sapiens; identical to SEQ ID NO: 379
  chr4:107955250-107955615
  hyper

SEQ ID NO: 7471 - DNA, 357 bp, Homo sapiens; identical to SEQ ID NO: 2438
  chr4:107956676-107957033
  hyper

SEQ ID NO: 7472 - DNA, 113 bp, Homo sapiens
  chr4:107957249-107957362
  hyper
ttcaaagttagcaggcgctttagtaggggatcaggagacgtccccggaccgaatcctcgagatctgaagagaatcgaggtcccccacacgcgcactcacagttgccccgaagc

SEQ ID NO: 7473 - DNA, 188 bp, Homo sapiens
  chr4:107957363-107957551
  hyper
ttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaag

SEQ ID NO: 7474 - DNA, 30 bp, Homo sapiens
  chr4:107957963-107957993
  hyper
ttctttgtgagctcacgtttggttttagac

SEQ ID NO: 7475 - DNA, 30 bp, Homo sapiens
  chr4:107958442-107958472
  hyper
ggtcgaaggctgctccgggaacgactggga

SEQ ID NO: 7476 - DNA, 213 bp, Homo sapiens
  chr4:109088250-109088463
  hyper
cctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaact

SEQ ID NO: 7477 - DNA, 207 bp, Homo sapiens
  chr4:109093307-109093514
  hyper
tcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctattt

SEQ ID NO: 7478 - DNA, 117 bp, Homo sapiens
  chr4:109093806-109093923
  hyper
ccagcgagcggggtccgccacccctcgcgccctcctgcggctttcccagcgctgggccagtgcaggccgagccctgcgtccctgcctcgctgggtgggggtccggggcgcggctgtc

SEQ ID NO: 7479 - DNA, 89 bp, Homo sapiens
  chr4:109094183-109094272
  hyper
ggggaatgcctagaacggagctagaatggaggtgggagctggagtcattttgcgggccacaggactgctcatttcgtgggcaggacgtg

SEQ ID NO: 7480 - DNA, 30 bp, Homo sapiens
  chr4:109683691-109683721
  hyper
gctagggctattggccgtcatccaccaacc

SEQ ID NO: 7481 - DNA, 70 bp, Homo sapiens
  chr4:109684016-109684086
  hyper
agccccagagtgtcccgcttactgtacagctcgcacatggtggcggggtgcagggcgctgcgaaggtgca

SEQ ID NO: 7482 - DNA, 104 bp, Homo sapiens
  chr4:110223324-110223428
  hyper
ccctgccttgctcagcgtccagacccgcaggcgtgcaccatccccgctttcttctctcctcccagctggaagtgaaaagcaccctccgtccggggactgggtgg

SEQ ID NO: 7483 - DNA, 20 bp, Homo sapiens
  chr4:110223578-110223598
  hyper
cggaggaccggacctgttgc

SEQ ID NO: 7484 - DNA, 245 bp, Homo sapiens
  chr4:110223599-110223844
  hyper
cctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaata

SEQ ID NO: 7485 - DNA, 37 bp, Homo sapiens
  chr4:110224118-110224155
  hyper
tgcaaatagctggagcggccaccgtgattggagagga

SEQ ID NO: 7486 - DNA, 306 bp, Homo sapiens; identical to SEQ ID NO: 2439
  chr4:111532704-111533010
  hyper

SEQ ID NO: 7487 - DNA, 132 bp, Homo sapiens
  chr4:111536561-111536693
  hyper
cgaggggactgactgcaccggctctgggagctaggtttctctcgctggatgggaaaaggaggtgcggaaaggggcaggcggcctgcgggctagcggggatgagagttgtggggagaacggaggagagagtaa

SEQ ID NO: 7488 - DNA, 30 bp, Homo sapiens
  chr4:111540349-111540379
  hyper
ccccaccccctggtacgtgctcccttaaca

SEQ ID NO: 7489 - DNA, 3 bp, Homo sapiens
  chr4:111540641-111540644
  hyper
gtc

SEQ ID NO: 7490 - DNA, 114 bp, Homo sapiens; identical to SEQ ID NO: 2440
  chr4:111543232-111543346
  hyper

SEQ ID NO: 7491 - DNA, 47 bp, Homo sapiens; identical to SEQ ID NO: 2441
  chr4:111543403-111543450
  hyper

SEQ ID NO: 7492 - DNA, 105 bp, Homo sapiens; identical to SEQ ID NO: 2442
  chr4:111544076-111544181
  hyper

SEQ ID NO: 7493 - DNA, 285 bp, Homo sapiens; identical to SEQ ID NO: 2443
  chr4:111544298-111544583
  hyper

SEQ ID NO: 7494 - DNA, 30 bp, Homo sapiens
  chr4:111549993-111550023
  hyper
gtaccgagtcagcagcgaggaacgcgacct

SEQ ID NO: 7495 - DNA, 215 bp, Homo sapiens
  chr4:111550629-111550844
  hyper
ggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagcca

SEQ ID NO: 7496 - DNA, 701 bp, Homo sapiens
  chr4:111552994-111553695
  hyper
cttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaa

SEQ ID NO: 7497 - DNA, 35 bp, Homo sapiens
  chr4:111555308-111555343
  hyper
agtaccgtttccctgcgtctcggcctctcctgaag

SEQ ID NO: 7498 - DNA, 133 bp, Homo sapiens
  chr4:111557898-111558031
  hyper
tatctcacatccctgcgggatagatggcctccacttaccggctaccgggagagagctgctgtctccgcgtcccactgcttcccggggcgatttccagcgagccgagcctccggctgcacggcaagcgcccgaa

SEQ ID NO: 7499 - DNA, 416 bp, Homo sapiens
  chr4:111558835-111559251
  hyper
gagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 7500 - DNA, 194 bp, Homo sapiens
  chr4:111560442-111560636
  hyper
gtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcc

SEQ ID NO: 7501 - DNA, 65 bp, Homo sapiens
  chr4:111562583-111562648
  hyper
cgtggccccgcaagtcgccaggccaagcttgctttttctgtctgcccctccggcaggctgggcgc

SEQ ID NO: 7502 - DNA, 32 bp, Homo sapiens
  chr4:113430640-113430672
  hyper
gccgagcatctctcacgcggttgacacctctc

SEQ ID NO: 7503 - DNA, 45 bp, Homo sapiens; identical to SEQ ID NO: 2444
  chr4:113431810-113431855
  hyper

SEQ ID NO: 7504 - DNA, 240 bp, Homo sapiens; identical to SEQ ID NO: 2445
  chr4:113431915-113432155
  hyper

SEQ ID NO: 7505 - DNA, 114 bp, Homo sapiens; identical to SEQ ID NO: 2446
  chr4:113432226-113432340
  hyper

SEQ ID NO: 7506 - DNA, 30 bp, Homo sapiens
  chr4:113432579-113432609
  hyper
cagcgcgctagctggcgttggaaagatcta

SEQ ID NO: 7507 - DNA, 556 bp, Homo sapiens
  chr4:113435837-113436393
  hyper
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtggggagcacctcgcgcagcgcgtccagtgccgcgttgaggttgtgcatgcggtttcgctcgcggttgttggccttcagtctacgggtcttcttgatgcgctgcaccgtctcggccgtcttggcgcctcgggagacggcccgcgcccgggaagggcgccgtttgcaatcgtgtaccagaccca

SEQ ID NO: 7508 - DNA, 342 bp, Homo sapiens
  chr4:113437629-113437971
  hyper
tggagctccgggctgcggccggagctggcgaagccgcagcggccgcagaggctcaagctgcggctgttgtcgccgccgctgtccattgtgattggtggctcgcgctcggctggagcgtgccgctaatttattaatgaatggaggtcgcgaggcgcagctggccaatcagggcgccctggactccgggaggcctgcgagccacgcgcaccggagcccgctccctttcagcagctcattaggggcccgagcgctgggggcggatggggggacccgtgctaccgcccccgccttcgtcctcgctgccgccgaggctccccccgcccggcgcgcgcgcaggcaccg

SEQ ID NO: 7509 - DNA, 30 bp, Homo sapiens
  chr4:113438171-113438201
  hyper
gagatgtggacacctcgtgaacaagtgtgt

SEQ ID NO: 7510 - DNA, 198 bp, Homo sapiens
  chr4:113438506-113438704
  hyper
tcctgcaagcaaatgcgctgcgctgacatttctgtgacctctgctccgcgctggggggcgttgtagggacaaggggcccatcttcccaattctgcttttcaatgagaaaaaagagctgaagggctactggacctcgggggaaacttgttctcaattgctcgttagccctccccactttccccacgttcatgcccaccc

SEQ ID NO: 7511 - DNA, 119 bp, Homo sapiens
  chr4:113441598-113441717
  hyper
ggtgactgtcgggggcgcgaaagagggcgcccttccctgagaggacaaaagccaaggtttggctatccagcgagcctgtcccccaattcacagtaaaccaccgtcggccaaaggagatg

SEQ ID NO: 7512 - DNA, 239 bp, Homo sapiens; identical to SEQ ID NO: 380
  chr4:113441947-113442186
  hyper

SEQ ID NO: 7513 - DNA, 237 bp, Homo sapiens; identical to SEQ ID NO: 381
  chr4:113442246-113442483
  hyper

SEQ ID NO: 7514 - DNA, 275 bp, Homo sapiens; identical to SEQ ID NO: 382
  chr4:113444020-113444295
  hyper

SEQ ID NO: 7515 - DNA, 133 bp, Homo sapiens; identical to SEQ ID NO: 383
  chr4:113444296-113444429
  hyper

SEQ ID NO: 7516 - DNA, 32 bp, Homo sapiens
  chr4:113626580-113626612
  hyper
aacaaagaatgtgtgcgcgtggaggctagagg

SEQ ID NO: 7517 - DNA, 153 bp, Homo sapiens
  chr4:117847306-117847459
  hyper
cgacccctcccatctcgctccccacatccccgcggacacagctggtggcgactcagacctctcgggcagcggctgcagggcgagcacagaggggactccgatgcgaaccgaggccccgggacccgccaggccacccgcgccgccgcccctctc

SEQ ID NO: 7518 - DNA, 11 bp, Homo sapiens
  chr4:117847469-117847480
  hyper
cgggcccgctc

SEQ ID NO: 7519 - DNA, 146 bp, Homo sapiens
  chr4:121844007-121844153
  hyper
gggcgcgggcctgggcgctgcgggcgccgggacgccgctcgctgattggcccgaagttggcggctctgacccgcgcccgggcgcgaagcccggagcagggctgaccccagggcctcaaacccggaggcccgcgagctgcgcgggcc

SEQ ID NO: 7520 - DNA, 114 bp, Homo sapiens
  chr4:121992426-121992540
  hyper
gaagaaagtatgagccggtcccaggccacctcgctcagcccaaggaagtttctataacgatgctcgcctaccacgcagaggacaaatgaggagccagagcggttgggggtcggg

SEQ ID NO: 7521 - DNA, 249 bp, Homo sapiens
  chr4:121993436-121993685
  hyper
atcccggggcagcgccgagaagcggcgggaggtccttttaaactgcagggagcgtgcgggggctgggcggcgggaggatgccgcagcgacccgcggggctggcgcgggcttcgccggccgccgctagtcgcacaggcgcctggctggagcgccgcgcggggtgctgggagagccgggcgcacggggcggcagcggccgtggcgggtgcgctgctcagttagctccactctctcgcggctggaagtgggg

SEQ ID NO: 7522 - DNA, 80 bp, Homo sapiens
  chr4:121993995-121994075
  hyper
cccaaacaggaccctcgcgggcggcatcgcgagggacacgctgctgtcctaaccttagcgccactcggggagaatgaagg

SEQ ID NO: 7523 - DNA, 30 bp, Homo sapiens
  chr4:121994303-121994333
  hyper
ccttcactcagggagcgcttccccctcggc

SEQ ID NO: 7524 - DNA, 251 bp, Homo sapiens; identical to SEQ ID NO: 384
  chr4:122301462-122301713
  hyper

SEQ ID NO: 7525 - DNA, 48 bp, Homo sapiens; identical to SEQ ID NO: 385
  chr4:122301962-122302010
  hyper

SEQ ID NO: 7526 - DNA, 60 bp, Homo sapiens
  chr4:122302243-122302303
  hyper
acccagcttcagtggcgccaacgccgcttccccgcaccctcagggcgagggaagacttcc

SEQ ID NO: 7527 - DNA, 244 bp, Homo sapiens; identical to SEQ ID NO: 386
  chr4:122686209-122686453
  hyper

SEQ ID NO: 7528 - DNA, 16 bp, Homo sapiens
  chr4:122686454-122686470
  hyper
gcgcagactctcccag

SEQ ID NO: 7529 - DNA, 1201 bp, Homo sapiens; identical to SEQ ID NO: 2455
  chr4:122871251-122872452
  hyper

SEQ ID NO: 7530 - DNA, 258 bp, Homo sapiens
  chr4:123747826-123748084
  hyper
cttgcgtgttgtggccgaaccgccgaactcagaggccggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccat

SEQ ID NO: 7531 - DNA, 354 bp, Homo sapiens
  chr4:123748540-123748894
  hyper
catttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacag

SEQ ID NO: 7532 - DNA, 208 bp, Homo sapiens
  chr4:126238000-126238208
  hyper
ggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccg

SEQ ID NO: 7533 - DNA, 143 bp, Homo sapiens
  chr4:128544048-128544191
  hyper
tgtccctggccaaggcggcctcgctgtcctggaagggagggtgaagagctgcatcccgcactaggcggcgaaagagggcagcgccaagcggcggggtccggaggcgctcgacggctcgcgcccagcgccggagacgggctgtg

SEQ ID NO: 7534 - DNA, 30 bp, Homo sapiens
  chr4:134067929-134067959
  hyper
agagcccccaaaaggcgagctctccaaagc

SEQ ID NO: 7535 - DNA, 61 bp, Homo sapiens
  chr4:134068338-134068399
  hyper
gcattagaaaattaccgtcattttttaaaaggctccaggattctgacgagtcagcttgaag

SEQ ID NO: 7536 - DNA, 43 bp, Homo sapiens
  chr4:134068856-134068899
  hyper
aggaggaaatggcaacgtatctccaggtcggaaaacgactcta

SEQ ID NO: 7537 - DNA, 103 bp, Homo sapiens
  chr4:134069793-134069896
  hyper
ccccacatcctttagcgtgaattcctccgctttttaggagtcacctccaccccctactccgtatgcttcgcgcctttcctcacggccccgtcagaccccctca

SEQ ID NO: 7538 - DNA, 101 bp, Homo sapiens
  chr4:134071103-134071204
  hyper
aatgaggctggattgcgggaagctctaaaatgaagcaaaaggagtaagatttttaaagacagaaagccacaggagcccccacgtagcgcacttttatttgt

SEQ ID NO: 7539 - DNA, 30 bp, Homo sapiens
  chr4:134071425-134071455
  hyper
acattacaaaactttcggctcgcgggtttc

SEQ ID NO: 7540 - DNA, 761 bp, Homo sapiens; identical to SEQ ID NO: 388
  chr4:134071850-134072611
  hyper

SEQ ID NO: 7541 - DNA, 304 bp, Homo sapiens; identical to SEQ ID NO: 389
  chr4:134072676-134072980
  hyper

SEQ ID NO: 7542 - DNA, 301 bp, Homo sapiens; identical to SEQ ID NO: 2458
  chr4:134073340-134073641
  hyper

SEQ ID NO: 7543 - DNA, 52 bp, Homo sapiens
  chr4:134074051-134074103
  hyper
gggagcagagatgggcggtcaccttctcccactccttcgtgtgtaacctaac

SEQ ID NO: 7544 - DNA, 565 bp, Homo sapiens; identical to SEQ ID NO: 390
  chr4:140200592-140201157
  hyper

SEQ ID NO: 7545 - DNA, 270 bp, Homo sapiens; identical to SEQ ID NO: 391
  chr4:140201192-140201462
  hyper

SEQ ID NO: 7546 - DNA, 38 bp, Homo sapiens
  chr4:140657110-140657148
  hyper
gcatttcccaggccccgccacatcgtgtgtgttagtgg

SEQ ID NO: 7547 - DNA, 47 bp, Homo sapiens
  chr4:141294349-141294396
  hyper
tttctctgcttggttcgcaaacgctcttttctcgaacttgaatgact

SEQ ID NO: 7548 - DNA, 143 bp, Homo sapiens
  chr4:141348038-141348181
  hyper
ctttcgcccgccccccggcggcgcacaatgggctctgcgcgggtatcgagggagcggccaacagtccctggccccaccgccgtgaagtggggtcccttcgcttccacataggtggagactgagacagccgagcctattttgat

SEQ ID NO: 7549 - DNA, 510 bp, Homo sapiens; identical to SEQ ID NO: 392
  chr4:141418921-141419431
  hyper

SEQ ID NO: 7550 - DNA, 173 bp, Homo sapiens
  chr4:141488870-141489043
  hyper
ctttttggaacagagcggagcccaaggcttttctgcccctcccaggaacgctcacggcttactttctttccctgcggtgaggaactcctggaccgtgtcgtagaggccgatcctgagagaggcggagctgatttgccgctgaagccccgcaggcagcccgctgtagagtttca

SEQ ID NO: 7551 - DNA, 142 bp, Homo sapiens
  chr4:142054074-142054216
  hyper
ccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaa

SEQ ID NO: 7552 - DNA, 134 bp, Homo sapiens
  chr4:143766796-143766930
  hyper
aaaaaacaaggcaaccgggaccaccaacatcagtcaccctcactccccaccactgcctctattccttaaggacttcttcccaggccggcggcggcggcggcggcggcggcggcagcttgcgatcatcaggattg

SEQ ID NO: 7553 - DNA, 104 bp, Homo sapiens; identical to SEQ ID NO: 393
  chr4:144621336-144621440
  hyper

SEQ ID NO: 7554 - DNA, 383 bp, Homo sapiens; identical to SEQ ID NO: 394
  chr4:144621514-144621897
  hyper

SEQ ID NO: 7555 - DNA, 173 bp, Homo sapiens; identical to SEQ ID NO: 395
  chr4:144621981-144622154
  hyper

SEQ ID NO: 7556 - DNA, 269 bp, Homo sapiens
  chr4:145568334-145568603
  hyper
atctctgaaaacagacgtttctgcggtacccgcaccctgggctgggtaaatattttaaaagaatcgcgatgaacagtgtgttttggatcgaatggggcattggctgcggtgaaactgtaaattaaggtggctgtggtttccggcttatttttctagggtaaaaagatttgtgctgttttctccacgtgctcggttagggagaggattgaatcgtaaaggatgttgaagcatggttggtttatgatccccagccccgtcagaggggggtg

SEQ ID NO: 7557 - DNA, 30 bp, Homo sapiens; identical to SEQ ID NO: 2465
  chr4:147558352-147558382
  hyper

SEQ ID NO: 7558 - DNA, 140 bp, Homo sapiens; identical to SEQ ID NO: 2466
  chr4:147558476-147558616
  hyper

SEQ ID NO: 7559 - DNA, 889 bp, Homo sapiens; identical to SEQ ID NO: 396
  chr4:147559190-147560079
  hyper

SEQ ID NO: 7560 - DNA, 286 bp, Homo sapiens; identical to SEQ ID NO: 397
  chr4:147560133-147560419
  hyper

SEQ ID NO: 7561 - DNA, 52 bp, Homo sapiens; identical to SEQ ID NO: 398
  chr4:147560459-147560511
  hyper

SEQ ID NO: 7562 - DNA, 525 bp, Homo sapiens
  chr4:147561425-147561950
  hyper
gctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgc

SEQ ID NO: 7563 - DNA, 96 bp, Homo sapiens
  chr4:147561999-147562095
  hyper
cgctcttttctctcctctcttctgcctcttttcacttttggcgactagaaacaattccagtaaatgtgaatctcgacaaatcgaggactgaagagg

SEQ ID NO: 7564 - DNA, 46 bp, Homo sapiens
  chr4:147568636-147568682
  hyper
ttttcaggaacaaatcgatgagatagggatgcgagagagggaagat

SEQ ID NO: 7565 - DNA, 41 bp, Homo sapiens
  chr4:147569117-147569158
  hyper
ctcgctggaggagctcgcccggtccccgaggggcccccaga

SEQ ID NO: 7566 - DNA, 515 bp, Homo sapiens; identical to SEQ ID NO: 2470
  chr4:147576329-147576844
  hyper

SEQ ID NO: 7567 - DNA, 30 bp, Homo sapiens
  chr4:151000206-151000236
  hyper
gagcactttgaggaacgggacaaaaggccg

SEQ ID NO: 7568 - DNA, 157 bp, Homo sapiens
  chr4:154143837-154143994
  hyper
agagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcag

SEQ ID NO: 7569 - DNA, 46 bp, Homo sapiens
  chr4:154144430-154144476
  hyper
gtcgcggacctctgccgtcctcagtcacccgcgtcatgcaggatag

SEQ ID NO: 7570 - DNA, 76 bp, Homo sapiens
  chr4:154680788-154680864
  hyper
ttccagaaggtcatgcgtccgtccccacgtctttccagggccggttctccccggtggggcccggggtcttggagac

SEQ ID NO: 7571 - DNA, 30 bp, Homo sapiens
  chr4:154709169-154709199
  hyper
tatttttttttaaaccgccgttcagttctt

SEQ ID NO: 7572 - DNA, 135 bp, Homo sapiens; identical to SEQ ID NO: 399
  chr4:154709476-154709611
  hyper

SEQ ID NO: 7573 - DNA, 70 bp, Homo sapiens; identical to SEQ ID NO: 400
  chr4:154709758-154709828
  hyper

SEQ ID NO: 7574 - DNA, 675 bp, Homo sapiens; identical to SEQ ID NO: 401
  chr4:154709829-154710504
  hyper

SEQ ID NO: 7575 - DNA, 66 bp, Homo sapiens; identical to SEQ ID NO: 2474
  chr4:154710734-154710800
  hyper

SEQ ID NO: 7576 - DNA, 684 bp, Homo sapiens; identical to SEQ ID NO: 2475
  chr4:154712024-154712708
  hyper

SEQ ID NO: 7577 - DNA, 30 bp, Homo sapiens
  chr4:154713980-154714010
  hyper
cgagaccagagtctgcgtctggagagcctt

SEQ ID NO: 7578 - DNA, 171 bp, Homo sapiens
  chr4:155254130-155254301
  hyper
cgcgtttctcgataacgactgtcagcaccagcagggctgcctgaggatgcacgccttggtcctcggccctgagagtcagcgtgagctcccgctgctcgcccgcgcccaggctgccgttgaggaacagcacccccagggctctgtcgatggcaaagacgcctggctgcgggc

SEQ ID NO: 7579 - DNA, 56 bp, Homo sapiens
  chr4:155411438-155411494
  hyper
cgaagtaggccgcgtcgcccagtgccccgccgccgctacccgccccaggcacttgc

SEQ ID NO: 7580 - DNA, 104 bp, Homo sapiens; identical to SEQ ID NO: 2476
  chr4:155412085-155412189
  hyper

SEQ ID NO: 7581 - DNA, 143 bp, Homo sapiens
  chr4:155413374-155413517
  hyper
gcctgactcttggctcgcgctgagccaagagggtagaggttatcatcactttggggtgccaaacttgtgttctccatttggcgagagggactcccgtccgcagcggaaggacagatggagtcaaaggccgatgcatagctggg

SEQ ID NO: 7582 - DNA, 149 bp, Homo sapiens; identical to SEQ ID NO: 402
  chr4:155663475-155663624
  hyper

SEQ ID NO: 7583 - DNA, 110 bp, Homo sapiens
  chr4:155664194-155664304
  hyper
acaggtgcctaggagcgcagagaggcctcgggttcaaatcaccggcgcgcagggactggactcgcgggtagcgacccccccaacccccccccccccgccctacacacaca

SEQ ID NO: 7584 - DNA, 63 bp, Homo sapiens
  chr4:155665385-155665448
  hyper
cgcagcacccctgcccggcgagcttaacttgcccagcccggcccctgccggagtggcaccggc

SEQ ID NO: 7585 - DNA, 30 bp, Homo sapiens
  chr4:155665748-155665778
  hyper
gtggtctccaacaagcgtctcatcctgggc

SEQ ID NO: 7586 - DNA, 480 bp, Homo sapiens; identical to SEQ ID NO: 2478
  chr4:156129606-156130086
  hyper

SEQ ID NO: 7587 - DNA, 140 bp, Homo sapiens
  chr4:156297416-156297556
  hyper
ggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaa

SEQ ID NO: 7588 - DNA, 27 bp, Homo sapiens
  chr4:156297941-156297968
  hyper
cgcccgcagagccggtcctggaccgag

SEQ ID NO: 7589 - DNA, 162 bp, Homo sapiens
  chr4:156588521-156588683
  hyper
gagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtac

SEQ ID NO: 7590 - DNA, 130 bp, Homo sapiens
  chr4:156588684-156588814
  hyper
ctcccagttgcccagccctgggaagccagcatcgggttcccacgctggggaggagcgagaggaaaggagaggacgcccgaggggccggcccagggcccgggggacccgcggcgcccgagggaggagcaca

SEQ ID NO: 7591 - DNA, 70 bp, Homo sapiens
  chr4:156680699-156680769
  hyper
agggtgggaagatagcgtgggggtggggcggatggtgacggggagaatccaccagggattggggggttgc

SEQ ID NO: 7592 - DNA, 200 bp, Homo sapiens
  chr4:156680770-156680970
  hyper
cccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgct

SEQ ID NO: 7593 - DNA, 32 bp, Homo sapiens
  chr4:158142980-158143012
  hyper
ctttcgggtgctgcacgcggaaggccagcgag

SEQ ID NO: 7594 - DNA, 97 bp, Homo sapiens
  chr4:158143369-158143466
  hyper
gttggacaaatcccacgagggactgccggagcccagtggcctcctgccccagcagctgccgctctcgcccgctgcccccagtttagatccgcagcac

SEQ ID NO: 7595 - DNA, 30 bp, Homo sapiens
  chr4:158144242-158144272
  hyper
actgcagttttcccacgtcacacaaacaac

SEQ ID NO: 7596 - DNA, 16 bp, Homo sapiens
  chr4:164253191-164253207
  hyper
cccagccagttactcc

SEQ ID NO: 7597 - DNA, 120 bp, Homo sapiens
  chr4:164253208-164253328
  hyper
cgaaaactccggtgcggccagagccagcgcctccagccagctcaagacacgtaaggaaaatgagcgggtgtgggataggcgaactcgggcgccttcccagtgcctcggccttttaaagag

SEQ ID NO: 7598 - DNA, 30 bp, Homo sapiens
  chr4:164264670-164264700
  hyper
ataaaacctgagagtcgaagcttgttctca

SEQ ID NO: 7599 - DNA, 98 bp, Homo sapiens; identical to SEQ ID NO: 2479
  chr4:164265532-164265630
  hyper

SEQ ID NO: 7600 - DNA, 167 bp, Homo sapiens
  chr4:165304472-165304639
  hyper
cgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggt

SEQ ID NO: 7601 - DNA, 95 bp, Homo sapiens; identical to SEQ ID NO: 2480
  chr4:165305095-165305190
  hyper

SEQ ID NO: 7602 - DNA, 61 bp, Homo sapiens
  chr4:166300073-166300134
  hyper
gccctcccagatccacgccggcccgtctctccgccggccccctcctcgcagtggtttctcc

SEQ ID NO: 7603 - DNA, 43 bp, Homo sapiens
  chr4:166300367-166300410
  hyper
gcagcgatggccgggcgagggggcagcgcgctgctggctctgt

SEQ ID NO: 7604 - DNA, 30 bp, Homo sapiens
  chr4:166793825-166793855
  hyper
ctgcaatctgtaactcgattttggattttt

SEQ ID NO: 7605 - DNA, 466 bp, Homo sapiens
  chr4:166794697-166795163
  hyper
cggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacac

SEQ ID NO: 7606 - DNA, 148 bp, Homo sapiens
  chr4:166796117-166796265
  hyper
cggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcgga

SEQ ID NO: 7607 - DNA, 383 bp, Homo sapiens
  chr4:168155125-168155508
  hyper
cggaacttacgtctcggaatttgttccactgtccgacttccttgtcatactgagagattgtggtgagccattgtttatcatccagaaaattaccgccgtccgaccgccccccggctgcagccaccgccgcggcagctgcgagagactgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 7608 - DNA, 98 bp, Homo sapiens; identical to SEQ ID NO: 2481
  chr4:172733771-172733869
  hyper

SEQ ID NO: 7609 - DNA, 88 bp, Homo sapiens; identical to SEQ ID NO: 403
  chr4:172734188-172734276
  hyper

SEQ ID NO: 7610 - DNA, 115 bp, Homo sapiens; identical to SEQ ID NO: 404
  chr4:172734277-172734392
  hyper

SEQ ID NO: 7611 - DNA, 14 bp, Homo sapiens
  chr4:172734591-172734605
  hyper
ggggagtggggcgc

SEQ ID NO: 7612 - DNA, 30 bp, Homo sapiens
  chr4:174429648-174429678
  hyper
cggacctctgcagtccgtcgcaggacgccc

SEQ ID NO: 7613 - DNA, 244 bp, Homo sapiens; identical to SEQ ID NO: 406
  chr4:174430310-174430554
  hyper

SEQ ID NO: 7614 - DNA, 279 bp, Homo sapiens; identical to SEQ ID NO: 407
  chr4:174430793-174431072
  hyper

SEQ ID NO: 7615 - DNA, 30 bp, Homo sapiens
  chr4:174438209-174438239
  hyper
ggaaggagaggaccacgaggctcccggcgc

SEQ ID NO: 7616 - DNA, 299 bp, Homo sapiens; identical to SEQ ID NO: 2487
  chr4:174439888-174440187
  hyper

SEQ ID NO: 7617 - DNA, 66 bp, Homo sapiens
  chr4:174440647-174440713
  hyper
ccacgcacacagccacggcccctcgcgtcttcgcggcacgttaattaaatgcggaaaacagacaga

SEQ ID NO: 7618 - DNA, 383 bp, Homo sapiens; identical to SEQ ID NO: 2488
  chr4:174443551-174443934
  hyper

SEQ ID NO: 7619 - DNA, 360 bp, Homo sapiens; identical to SEQ ID NO: 2489
  chr4:174449950-174450310
  hyper

SEQ ID NO: 7620 - DNA, 162 bp, Homo sapiens; identical to SEQ ID NO: 2490
  chr4:174450565-174450727
  hyper

SEQ ID NO: 7621 - DNA, 173 bp, Homo sapiens; identical to SEQ ID NO: 2491
  chr4:174450751-174450924
  hyper

SEQ ID NO: 7622 - DNA, 243 bp, Homo sapiens; identical to SEQ ID NO: 408
  chr4:174451855-174452098
  hyper

SEQ ID NO: 7623 - DNA, 30 bp, Homo sapiens
  chr4:174459927-174459957
  hyper
cctctgcgctccgggcgggtggaggaagcg

SEQ ID NO: 7624 - DNA, 47 bp, Homo sapiens
  chr4:175133127-175133174
  hyper
aatccccagctccctcgcgtcagcgaatgtcccgctggtccaggcag

SEQ ID NO: 7625 - DNA, 67 bp, Homo sapiens
  chr4:175134868-175134935
  hyper
cctctgggtccttaccgaaagggaaggtcccaaaggaccaccagcgcgctctcggaggctccaggac

SEQ ID NO: 7626 - DNA, 435 bp, Homo sapiens; identical to SEQ ID NO: 2493
  chr4:175135253-175135688
  hyper

SEQ ID NO: 7627 - DNA, 30 bp, Homo sapiens
  chr4:175137723-175137753
  hyper
gcgtttctctaagtccgagcccccatctct

SEQ ID NO: 7628 - DNA, 256 bp, Homo sapiens
  chr4:175138513-175138769
  hyper
acgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggct

SEQ ID NO: 7629 - DNA, 109 bp, Homo sapiens
  chr4:175139224-175139333
  hyper
gacctctaatagggtcggtggaagctaatttgaatcttcccagttccttccctgtttatttctcaacccagcagttcaaaaattcactttataacggtcccctaacaaa

SEQ ID NO: 7630 - DNA, 54 bp, Homo sapiens
  chr4:175139631-175139685
  hyper
acccagcctggcagtcggaagacagtgagataaagaatgcgatagtaagtcctt

SEQ ID NO: 7631 - DNA, 387 bp, Homo sapiens; identical to SEQ ID NO: 2494
  chr4:175750264-175750651
  hyper

SEQ ID NO: 7632 - DNA, 57 bp, Homo sapiens
  chr4:176923024-176923081
  hyper
aagagaacatgaaaacgtgggaactcgggaggacagagatctccctgtaatcgcctc

SEQ ID NO: 7633 - DNA, 20 bp, Homo sapiens
  chr4:176923082-176923102
  hyper
ctattcggatcctgggtctc

SEQ ID NO: 7634 - DNA, 241 bp, Homo sapiens
  chr4:176923402-176923643
  hyper
gcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctcc

SEQ ID NO: 7635 - DNA, 124 bp, Homo sapiens; identical to SEQ ID NO: 2495
  chr4:176987050-176987174
  hyper

SEQ ID NO: 7636 - DNA, 5 bp, Homo sapiens
  chr4:176987175-176987180
  hyper
cccgc

SEQ ID NO: 7637 - DNA, 107 bp, Homo sapiens; identical to SEQ ID NO: 2497
  chr4:176987206-176987313
  hyper

SEQ ID NO: 7638 - DNA, 13 bp, Homo sapiens
  chr4:176987314-176987327
  hyper
agaggggctctga

SEQ ID NO: 7639 - DNA, 39 bp, Homo sapiens
  chr4:177713271-177713310
  hyper
cctaacgcaaactctcgggttctccgcaaaccctaacgc

SEQ ID NO: 7640 - DNA, 530 bp, Homo sapiens
  chr4:177713662-177714192
  hyper
agtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagct

SEQ ID NO: 7641 - DNA, 30 bp, Homo sapiens
  chr4:180979304-180979334
  hyper
gggtctggagtgtcacgtaggcaccccaac

SEQ ID NO: 7642 - DNA, 91 bp, Homo sapiens
  chr4:183062455-183062546
  hyper
acgacgtgagctgcccgccatccccgccctctcttgacaacagctcagtgaggtaaaaagcatgatggtcacgtagcgagctgcctctctg

SEQ ID NO: 7643 - DNA, 155 bp, Homo sapiens
  chr4:183063795-183063950
  hyper
cgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccg

SEQ ID NO: 7644 - DNA, 38 bp, Homo sapiens
  chr4:183064617-183064655
  hyper
ttctgcctcggaatccgtcttcccggcagtgtcttgca

SEQ ID NO: 7645 - DNA, 30 bp, Homo sapiens
  chr4:183065138-183065168
  hyper
gaaaaaggcagtaaacggggaatctctttt

SEQ ID NO: 7646 - DNA, 76 bp, Homo sapiens
  chr4:184718260-184718336
  hyper
gagcgtggggaggagcgacactcgccgctccggaatccgtgccttccaagtgtcgccgttgcgtcccccgcaaccc

SEQ ID NO: 7647 - DNA, 69 bp, Homo sapiens
  chr4:184826238-184826307
  hyper
tttgaaaacccaaatcgaggagataaccgtttttgaatgaacggcagtgcaaagcgtggtcggggttag

SEQ ID NO: 7648 - DNA, 33 bp, Homo sapiens
  chr4:184826624-184826657
  hyper
ggttgtgggggagctcgccgtggcctcccctcc

SEQ ID NO: 7649 - DNA, 35 bp, Homo sapiens
  chr4:184827167-184827202
  hyper
ctgcagtcgcggggacgacgcgggctcttcctgga

SEQ ID NO: 7650 - DNA, 164 bp, Homo sapiens
  chr4:185937754-185937918
  hyper
gcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctccc

SEQ ID NO: 7651 - DNA, 391 bp, Homo sapiens
  chr4:185938343-185938734
  hyper
ccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgt

SEQ ID NO: 7652 - DNA, 212 bp, Homo sapiens
  chr4:185939694-185939906
  hyper
ccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaat

SEQ ID NO: 7653 - DNA, 88 bp, Homo sapiens
  chr4:185940294-185940382
  hyper
ctgcctggaggctggcggccacctccccaaaggcctgggtagggtggctggaaggggagcgcgccagcgcgggcgtcagaaggcagag

SEQ ID NO: 7654 - DNA, 67 bp, Homo sapiens
  chr4:185941560-185941627
  hyper
ttgcagtccaaggcccgcctgggcgcggagcccgcctttccgccgctgggttcgctcccggagccgg

SEQ ID NO: 7655 - DNA, 315 bp, Homo sapiens; identical to SEQ ID NO: 2499
  chr4:185941868-185942183
  hyper

SEQ ID NO: 7656 - DNA, 443 bp, Homo sapiens
  chr4:185942491-185942934
  hyper
cgcccgcgggtctggaatgcggcgaaacccgggccagcggggcgcgtggctgagtttacagaattaaaaatcctctaaaaaataccggaaccaagtacagttctgagttgcggattagaaacaacatcgttgatgacaactgctcagcgccagaggcttccgagaagctggcgttgccttttgcgcacagagcaggccagcttcgggggcgctgggcgtctcggcgagaggtcggcacctgccgggttgggagacgccccttccccaccccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 7657 - DNA, 40 bp, Homo sapiens
  chr4:186048748-186048788
  hyper
ttgctgagttatgtccgggcgagatcggtgtccttcaggg

SEQ ID NO: 7658 - DNA, 70 bp, Homo sapiens
  chr4:186049492-186049562
  hyper
tccaggcgtgagccccgcgccctccccttgcggagattcggcctggaaagctccgcggctctggccggca

SEQ ID NO: 7659 - DNA, 57 bp, Homo sapiens
  chr4:186049764-186049821
  hyper
agagcgcagcagaggcggggaggaggcgcgagcggaggggaccgacttccaccgcac

SEQ ID NO: 7660 - DNA, 61 bp, Homo sapiens
  chr5:53500-53561
  hyper
cgagtccccttctcaggcaggctgtgggggttggggttgggcttcgcgagcccaagcggac

SEQ ID NO: 7661 - DNA, 50 bp, Homo sapiens
  chr5:53849-53899
  hyper
ggggacctcggtgcccggagctgctgcccaggtaaccgcgctgcgcccgg

SEQ ID NO: 7662 - DNA, 30 bp, Homo sapiens
  chr5:54402-54432
  hyper
ccacgctcctgtgtgcgagaggggcctggt

SEQ ID NO: 7663 - DNA, 74 bp, Homo sapiens
  chr5:92039-92113
  hyper
caggtccccgagctccgggctccgagagaacaaaagcagaagccactgccgcccgcgctcggggaggagccgcc

SEQ ID NO: 7664 - DNA, 494 bp, Homo sapiens
  chr5:320840-321334
  hyper
agggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 7665 - DNA, 213 bp, Homo sapiens
  chr5:374129-374342
  hyper
aaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggg

SEQ ID NO: 7666 - DNA, 67 bp, Homo sapiens
  chr5:524337-524404
  hyper
cgccgggctccacctcgacgcccccggcccgcgccagcccgcccagcgccagcgccagcagcagccc

SEQ ID NO: 7667 - DNA, 82 bp, Homo sapiens
  chr5:524772-524854
  hyper
gcgagcccgggactgcgcggccgccttcctggggcgtggggagcacagcgcggggcagcgggacaggcggttccgcgcagct

SEQ ID NO: 7668 - DNA, 836 bp, Homo sapiens; identical to SEQ ID NO: 409
  chr5:1294607-1295443
  hyper

SEQ ID NO: 7669 - DNA, 75 bp, Homo sapiens; identical to SEQ ID NO: 410
  chr5:1295604-1295679
  hyper

SEQ ID NO: 7670 - DNA, 52 bp, Homo sapiens
  chr5:1444711-1444763
  hyper
ccggcacgacccctccggtgggtaaaacacccgacgaaggggttccgcggcg

SEQ ID NO: 7671 - DNA, 99 bp, Homo sapiens
  chr5:1445157-1445256
  hyper
agccatagacacccacgcgtcccctaagccggtgactgcaccaggtgcccacccggttctgagcctggagcggggccaggggcagccctgcaccctcct

SEQ ID NO: 7672 - DNA, 114 bp, Homo sapiens
  chr5:1445840-1445954
  hyper
cgcccgcacccctgggggctgccccgggcacccgctatcttcggacgcccagggctggcggctcccagctggacggggagggagccgagcggctgcgcgcggggaactgctggg

SEQ ID NO: 7673 - DNA, 126 bp, Homo sapiens; identical to SEQ ID NO: 2502
  chr5:1446236-1446362
  hyper

SEQ ID NO: 7674 - DNA, 214 bp, Homo sapiens
  chr5:1667861-1668075
  hyper
cctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaac

SEQ ID NO: 7675 - DNA, 133 bp, Homo sapiens
  chr5:1851756-1851889
  hyper
tggagtggctcaggccgctgatgagggtgctcggggcagggctcttctctgagtgacgttggaggttttcacggtgaacacagaaaggggcactccgtccgagctgagcctcagggaccgtgaggcttgctct

SEQ ID NO: 7676 - DNA, 517 bp, Homo sapiens; identical to SEQ ID NO: 411
  chr5:1875025-1875542
  hyper

SEQ ID NO: 7677 - DNA, 478 bp, Homo sapiens; identical to SEQ ID NO: 412
  chr5:1875829-1876307
  hyper

SEQ ID NO: 7678 - DNA, 223 bp, Homo sapiens; identical to SEQ ID NO: 413
  chr5:1876637-1876860
  hyper

SEQ ID NO: 7679 - DNA, 28 bp, Homo sapiens
  chr5:1877194-1877222
  hyper
cgatgggctcccacgcccccccccggga

SEQ ID NO: 7680 - DNA, 15 bp, Homo sapiens
  chr5:1878014-1878029
  hyper
ctcagtgaaaagagt

SEQ ID NO: 7681 - DNA, 354 bp, Homo sapiens; identical to SEQ ID NO: 2508
  chr5:1878223-1878577
  hyper

SEQ ID NO: 7682 - DNA, 43 bp, Homo sapiens; identical to SEQ ID NO: 2509
  chr5:1878830-1878873
  hyper

SEQ ID NO: 7683 - DNA, 124 bp, Homo sapiens
  chr5:1879538-1879662
  hyper
aagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 7684 - DNA, 6 bp, Homo sapiens
  chr5:1879689-1879695
  hyper
cgtagg

SEQ ID NO: 7685 - DNA, 503 bp, Homo sapiens; identical to SEQ ID NO: 2510
  chr5:1882419-1882922
  hyper

SEQ ID NO: 7686 - DNA, 187 bp, Homo sapiens; identical to SEQ ID NO: 414
  chr5:1883430-1883617
  hyper

SEQ ID NO: 7687 - DNA, 347 bp, Homo sapiens; identical to SEQ ID NO: 415
  chr5:1883879-1884226
  hyper

SEQ ID NO: 7688 - DNA, 174 bp, Homo sapiens; identical to SEQ ID NO: 416
  chr5:1884557-1884731
  hyper

SEQ ID NO: 7689 - DNA, 67 bp, Homo sapiens; identical to SEQ ID NO: 417
  chr5:1885314-1885381
  hyper

SEQ ID NO: 7690 - DNA, 16 bp, Homo sapiens
  chr5:1886061-1886077
  hyper
gggccagaagtcagcc

SEQ ID NO: 7691 - DNA, 160 bp, Homo sapiens
  chr5:1886379-1886539
  hyper
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtggg

SEQ ID NO: 7692 - DNA, 103 bp, Homo sapiens; identical to SEQ ID NO: 418
  chr5:1886739-1886842
  hyper

SEQ ID NO: 7693 - DNA, 149 bp, Homo sapiens; identical to SEQ ID NO: 419
  chr5:1886997-1887146
  hyper

SEQ ID NO: 7694 - DNA, 36 bp, Homo sapiens; identical to SEQ ID NO: 420
  chr5:1887546-1887582
  hyper

SEQ ID NO: 7695 - DNA, 101 bp, Homo sapiens; identical to SEQ ID NO: 421
  chr5:1887655-1887756
  hyper

SEQ ID NO: 7696 - DNA, 31 bp, Homo sapiens; identical to SEQ ID NO: 422
  chr5:1930974-1931005
  hyper

SEQ ID NO: 7697 - DNA, 223 bp, Homo sapiens; identical to SEQ ID NO: 423
  chr5:1931064-1931287
  hyper

SEQ ID NO: 7698 - DNA, 133 bp, Homo sapiens; identical to SEQ ID NO: 424
  chr5:1931444-1931577
  hyper

SEQ ID NO: 7699 - DNA, 349 bp, Homo sapiens; identical to SEQ ID NO: 425
  chr5:1931617-1931966
  hyper

SEQ ID NO: 7700 - DNA, 424 bp, Homo sapiens; identical to SEQ ID NO: 2523
  chr5:2038439-2038863
  hyper

SEQ ID NO: 7701 - DNA, 160 bp, Homo sapiens; identical to SEQ ID NO: 2524
  chr5:2738820-2738980
  hyper

SEQ ID NO: 7702 - DNA, 28 bp, Homo sapiens
  chr5:2739210-2739238
  hyper
cgaggggactcaacgcgctttgtagggc

SEQ ID NO: 7703 - DNA, 51 bp, Homo sapiens
  chr5:2739946-2739997
  hyper
tgggaggcaagaggtcgggggaggccggggtcagggcgggaggaacccgat

SEQ ID NO: 7704 - DNA, 42 bp, Homo sapiens
  chr5:2740259-2740301
  hyper
ggccgggtctggggccgccggggcagtcgtggcgtgcggggg

SEQ ID NO: 7705 - DNA, 235 bp, Homo sapiens
  chr5:2740430-2740665
  hyper
cggtcacaccggggctgaggtcaggagccggctcaccccctctcctgcgactgttccctgacctgcgactgttcggttctcccgactggccttggtcgttgccttttagggtctcggtgtgaccaactaagcagacactcagcggcagcgccgcgcttggggagactgcagggcagaaatgggcctagaggtgaaggagcccttcccaaatcggacagtcccggggctggagagc

SEQ ID NO: 7706 - DNA, 43 bp, Homo sapiens; identical to SEQ ID NO: 2525
  chr5:2743617-2743660
  hyper

SEQ ID NO: 7707 - DNA, 46 bp, Homo sapiens; identical to SEQ ID NO: 2526
  chr5:2743698-2743744
  hyper

SEQ ID NO: 7708 - DNA, 42 bp, Homo sapiens
  chr5:2748353-2748395
  hyper
cctggatcttcttcccggaccctccctcgggtctcccgggcg

SEQ ID NO: 7709 - DNA, 146 bp, Homo sapiens
  chr5:2749261-2749407
  hyper
cgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 7710 - DNA, 83 bp, Homo sapiens; identical to SEQ ID NO: 2527
  chr5:2751854-2751937
  hyper

SEQ ID NO: 7711 - DNA, 200 bp, Homo sapiens
  chr5:2752242-2752442
  hyper
ggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcc

SEQ ID NO: 7712 - DNA, 294 bp, Homo sapiens
  chr5:2752898-2753192
  hyper
ggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctgggg

SEQ ID NO: 7713 - DNA, 30 bp, Homo sapiens
  chr5:2754590-2754620
  hyper
gaaatatataaactacgttttgctttaaag

SEQ ID NO: 7714 - DNA, 129 bp, Homo sapiens
  chr5:2755360-2755489
  hyper
cgggcggcgagggggcgctgtggcccgtgtctgccggcccgagtcccggcaacggtgggcgcgacccacctcctcccccggcggcttaattcggggaagaagaaaaaacggcatcgaggcatttcaata

SEQ ID NO: 7715 - DNA, 326 bp, Homo sapiens; identical to SEQ ID NO: 2528
  chr5:2755916-2756242
  hyper

SEQ ID NO: 7716 - DNA, 139 bp, Homo sapiens
  chr5:2756464-2756603
  hyper
aattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 7717 - DNA, 633 bp, Homo sapiens
  chr5:2756673-2757306
  hyper
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagatagga

SEQ ID NO: 7718 - DNA, 30 bp, Homo sapiens
  chr5:3122164-3122194
  hyper
cacacagtgccccagcgccaggcagcgggg

SEQ ID NO: 7719 - DNA, 41 bp, Homo sapiens
  chr5:3197756-3197797
  hyper
aatctaaagaacccgcggtcctgtggcgtgatttcctggga

SEQ ID NO: 7720 - DNA, 253 bp, Homo sapiens; identical to SEQ ID NO: 426
  chr5:3590405-3590658
  hyper

SEQ ID NO: 7721 - DNA, 123 bp, Homo sapiens
  chr5:3591143-3591266
  hyper
gtaattcacttccttcgacactggggacggcgtcgtagcggcactccaggccaggccactgcggtccattcctctgccctgcgtttgtgggaaatacgggcccagtgccgcagctttagggcc

SEQ ID NO: 7722 - DNA, 99 bp, Homo sapiens
  chr5:3594407-3594506
  hyper
gtctgtcctcaggcccggaaaaccggagcccctcctgatgctgctgaagtccctgggcctcgaggctccgtgaagagagggaagcgaggcagggggtga

SEQ ID NO: 7723 - DNA, 145 bp, Homo sapiens
  chr5:3596580-3596725
  hyper
cgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcc

SEQ ID NO: 7724 - DNA, 50 bp, Homo sapiens
  chr5:3597411-3597461
  hyper
tcggtgcttaaacttcggacggctggtgaattgtgcggcgggcgcggggc

SEQ ID NO: 7725 - DNA, 21 bp, Homo sapiens
  chr5:3600732-3600753
  hyper
cgtccccaggccagattcgcc

SEQ ID NO: 7726 - DNA, 459 bp, Homo sapiens
  chr5:3602804-3603263
  hyper
agcgagggggaaagtcggggcgctggtgtcttttcagaggttccaggaaagagggaggctcgcgttaggactaggaggtgccagtccacggctcctacccgctcccgacgcccgcatccttctacagccctccaccccgttcctggtccctgtagaggggaaggtcctctccctgccccgaggcgggaggaaaagcggcgaagaggaggctcgaagggcgccgcgtagggcaagtgggccgaggacaccgggggcgcgtcggggagcggggagtgggcggggtgggatgaggcagggaggagccgggccggagcggagtggagtggaccgcgggcggacggactcgggccgggccccggggagcagctccgcagtcggaatggacgtgctccaggcgccctctatggtccgaaagcggaatgcggccttgagcagcgcccatctcgctcctggggtgtg

SEQ ID NO: 7727 - DNA, 34 bp, Homo sapiens
  chr5:3606775-3606809
  hyper
atttatccagagtcccgagcgcaatggctggtgc

SEQ ID NO: 7728 - DNA, 30 bp, Homo sapiens
  chr5:3607118-3607148
  hyper
cggacgccctgatagcggggtgacagcctg

SEQ ID NO: 7729 - DNA, 247 bp, Homo sapiens
  chr5:5139753-5140000
  hyper
cggggcaaatggcgcgggggaagagtttcctcctcagcctccccgtctccgatcgctccgcaaactccagagcgaggcacgcgcctttaaaggcaggtccgcggctctcccacgtcctggcgcccggttttccgcacccagtgtccccacagctgtgcccgggcacagaggcgcggccagaccgcactccgcgggctgcaggtgtcccggcctctggcggcgccggtgcggcccggaggtgggagcc

SEQ ID NO: 7730 - DNA, 137 bp, Homo sapiens
  chr5:5140031-5140168
  hyper
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgt

SEQ ID NO: 7731 - DNA, 18 bp, Homo sapiens
  chr5:5140438-5140456
  hyper
cttcagtaataaccccgg

SEQ ID NO: 7732 - DNA, 231 bp, Homo sapiens
  chr5:5140527-5140758
  hyper
cgctgccggccggggaccctccggtggcccctagcccctcggagcgctcctggatgaagccccgcgcgcgcggatggcggggcttggcggcgctgtggatgctgttggcgcaggtggccgagcaggtgagtcccgggcgctcccaccagcgcggaaaccgcgggtccggacagctggaggcgagtcccccgcggctcctctcccgcggaccccgccgtctcaccgcgatgt

SEQ ID NO: 7733 - DNA, 24 bp, Homo sapiens
  chr5:5140849-5140873
  hyper
cggagcggccgggctggatggaaa

SEQ ID NO: 7734 - DNA, 844 bp, Homo sapiens; identical to SEQ ID NO: 427
  chr5:6448738-6449582
  hyper

SEQ ID NO: 7735 - DNA, 367 bp, Homo sapiens
  chr5:6583189-6583556
  hyper
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggct

SEQ ID NO: 7736 - DNA, 30 bp, Homo sapiens
  chr5:6687127-6687157
  hyper
cgcttcctaataaaacggcattccaggttc

SEQ ID NO: 7737 - DNA, 30 bp, Homo sapiens
  chr5:6687371-6687401
  hyper
ggggcagagccagctcggagccagcgctgc

SEQ ID NO: 7738 - DNA, 101 bp, Homo sapiens; identical to SEQ ID NO: 2531
  chr5:7395293-7395394
  hyper

SEQ ID NO: 7739 - DNA, 113 bp, Homo sapiens; identical to SEQ ID NO: 2532
  chr5:7395433-7395546
  hyper

SEQ ID NO: 7740 - DNA, 49 bp, Homo sapiens
  chr5:7396986-7397035
  hyper
cctgggcttcctgggcgagtcgctgtctcctgcccggttccactggcat

SEQ ID NO: 7741 - DNA, 177 bp, Homo sapiens
  chr5:7850962-7851139
  hyper
tccgcgcccagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgc

SEQ ID NO: 7742 - DNA, 36 bp, Homo sapiens
  chr5:9546612-9546648
  hyper
gcgctccctctctgccggcctcggcttcaggtacgt

SEQ ID NO: 7743 - DNA, 496 bp, Homo sapiens; identical to SEQ ID NO: 2533
  chr5:10333618-10334114
  hyper

SEQ ID NO: 7744 - DNA, 31 bp, Homo sapiens; identical to SEQ ID NO: 428
  chr5:10564628-10564659
  hyper

SEQ ID NO: 7745 - DNA, 428 bp, Homo sapiens; identical to SEQ ID NO: 429
  chr5:10564800-10565228
  hyper

SEQ ID NO: 7746 - DNA, 1 bp, Homo sapiens
  chr5:10565262-10565263
  hyper
c

SEQ ID NO: 7747 - DNA, 358 bp, Homo sapiens; identical to SEQ ID NO: 431
  chr5:10565264-10565622
  hyper

SEQ ID NO: 7748 - DNA, 321 bp, Homo sapiens
  chr5:11385070-11385391
  hyper
gcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcaca

SEQ ID NO: 7749 - DNA, 180 bp, Homo sapiens
  chr5:11903545-11903725
  hyper
caccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccc

SEQ ID NO: 7750 - DNA, 293 bp, Homo sapiens
  chr5:11903821-11904114
  hyper
cgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggc

SEQ ID NO: 7751 - DNA, 59 bp, Homo sapiens
  chr5:11904115-11904174
  hyper
gcaggggcgagcgccgcgggcgagaggcggctcccgacgcgagtgcgcagcgcccggcc

SEQ ID NO: 7752 - DNA, 6 bp, Homo sapiens
  chr5:11904195-11904201
  hyper
cgagcg

SEQ ID NO: 7753 - DNA, 88 bp, Homo sapiens; identical to SEQ ID NO: 2538
  chr5:11904455-11904543
  hyper

SEQ ID NO: 7754 - DNA, 30 bp, Homo sapiens
  chr5:11904962-11904992
  hyper
agagctaaggaggcacgaagtccagcagag

SEQ ID NO: 7755 - DNA, 30 bp, Homo sapiens
  chr5:15500979-15501009
  hyper
agtgagtaggtcaggcgccccgaggatgct

SEQ ID NO: 7756 - DNA, 30 bp, Homo sapiens
  chr5:15501264-15501294
  hyper
tttccattctttgctcgctgctcctgctct

SEQ ID NO: 7757 - DNA, 30 bp, Homo sapiens
  chr5:16179111-16179141
  hyper
cgccaccggctgcctcggggtctcgccggg

SEQ ID NO: 7758 - DNA, 28 bp, Homo sapiens
  chr5:16179554-16179582
  hyper
cggggaccggggccggctctcccggcgg

SEQ ID NO: 7759 - DNA, 139 bp, Homo sapiens; identical to SEQ ID NO: 2540
  chr5:16180182-16180321
  hyper

SEQ ID NO: 7760 - DNA, 53 bp, Homo sapiens; identical to SEQ ID NO: 2541
  chr5:16180371-16180424
  hyper

SEQ ID NO: 7761 - DNA, 43 bp, Homo sapiens
  chr5:17216867-17216910
  hyper
cgaagctgcagccttcggggctgagccccgcgggtgcgggtgc

SEQ ID NO: 7762 - DNA, 16 bp, Homo sapiens
  chr5:17217708-17217724
  hyper
atgcagaggctgcagc

SEQ ID NO: 7763 - DNA, 81 bp, Homo sapiens
  chr5:17217784-17217865
  hyper
tcctcgctccgggctccgccgtcgagccgggagagagcctccgccagcggccaggcaccagccagacgacgccagcgaccc

SEQ ID NO: 7764 - DNA, 49 bp, Homo sapiens
  chr5:17217991-17218040
  hyper
cgccccgcagcccccgggctctcccttcatgcagcgggcagcagggatg

SEQ ID NO: 7765 - DNA, 276 bp, Homo sapiens
  chr5:17218658-17218934
  hyper
ttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 7766 - DNA, 49 bp, Homo sapiens
  chr5:17218985-17219034
  hyper
cgtccccagagacatttccgccttgaaacgaactcggtggacagccctt

SEQ ID NO: 7767 - DNA, 121 bp, Homo sapiens; identical to SEQ ID NO: 2542
  chr5:22853104-22853225
  hyper

SEQ ID NO: 7768 - DNA, 159 bp, Homo sapiens; identical to SEQ ID NO: 2543
  chr5:31639686-31639845
  hyper

SEQ ID NO: 7769 - DNA, 270 bp, Homo sapiens
  chr5:31855221-31855491
  hyper
gactcccaggagctccggagaggaaccctccgaaggtgacttcagaactggaggtaggaaatcggcttctcaggcgaaagcctcaggttttctgatctgatccaggtcgggtgcagactggggctgaatccacaaatgtggagatttagccacagcctcggaggcgcggagcggccacctaagcgtctgcccttctcgtctcccggatcactggggtgtgttgtttttaaagtgggggatttgcgtgttgagagacggtttgtgttcctc

SEQ ID NO: 7770 - DNA, 66 bp, Homo sapiens
  chr5:32710234-32710300
  hyper
atgctcctctggtcacggacttctccagagccgcttccctccggtctccaccgctgctgtggctat

SEQ ID NO: 7771 - DNA, 183 bp, Homo sapiens
  chr5:32710598-32710781
  hyper
ttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 7772 - DNA, 52 bp, Homo sapiens
  chr5:32711377-32711429
  hyper
gctcagccgctgccacgctatttaaacgcgggctatggatccaggaaccggc

SEQ ID NO: 7773 - DNA, 49 bp, Homo sapiens
  chr5:32711430-32711479
  hyper
cgaatcaatgagatcaaatgcgagggagatgcaccgtcaattacaaaca

SEQ ID NO: 7774 - DNA, 99 bp, Homo sapiens; identical to SEQ ID NO: 2544
  chr5:32711765-32711864
  hyper

SEQ ID NO: 7775 - DNA, 25 bp, Homo sapiens
  chr5:32712077-32712102
  hyper
ttgttttcactcacccgggtgcggc

SEQ ID NO: 7776 - DNA, 563 bp, Homo sapiens; identical to SEQ ID NO: 2546
  chr5:32712289-32712852
  hyper

SEQ ID NO: 7777 - DNA, 495 bp, Homo sapiens
  chr5:33892054-33892549
  hyper
gggtgcatggtcaggcgcgagaaggcagcgactgcaaagctgcccgcgatctccctgtgcttttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggaggcactggaggaagctgcgagtgagaggcccccaggccagccccccggcgtgcttaaatacaagctcaaaatgaggagaacagagttgaggcagaggggggccccactccctccatccttccgcgctcagcgctgccc

SEQ ID NO: 7778 - DNA, 116 bp, Homo sapiens
  chr5:33936246-33936362
  hyper
gcccgccgccttggccgtgcaagtgccaccgtaactggtgagagccgctggcaacccacccggagttgacaaccgcggagagacgcagacacccactgacctccaggaagctgagc

SEQ ID NO: 7779 - DNA, 136 bp, Homo sapiens
  chr5:33936363-33936499
  hyper
tggtggatggaactctacgatctctttctctccaaggacggaaacctcatccaagcagtcccagaggaaacggataaaggtatttgaaagggagcgagcggccccaaatcgcacaattgagcggctgggggagtta

SEQ ID NO: 7780 - DNA, 133 bp, Homo sapiens
  chr5:36690192-36690325
  hyper
gttctgttagctgaacgggcctggaggaagcgtggcgggaaggctggatccccgccgcaggggctgcggggctgtggctgcctgcgggctgggcagggccgggcgcacgccctccttccgggtggccgcgggc

SEQ ID NO: 7781 - DNA, 65 bp, Homo sapiens
  chr5:37834672-37834737
  hyper
gtgcggggctggctgcgggtgggggtgcgagggggtccgccggcggcccccccgcggggagggaa

SEQ ID NO: 7782 - DNA, 1728 bp, Homo sapiens; identical to SEQ ID NO: 2547
  chr5:37836649-37838377
  hyper

SEQ ID NO: 7783 - DNA, 285 bp, Homo sapiens; identical to SEQ ID NO: 2548
  chr5:37838600-37838885
  hyper

SEQ ID NO: 7784 - DNA, 30 bp, Homo sapiens
  chr5:37839237-37839267
  hyper
cgacggcggtgggttcgaagatgacccaag

SEQ ID NO: 7785 - DNA, 268 bp, Homo sapiens; identical to SEQ ID NO: 2549
  chr5:37839807-37840075
  hyper

SEQ ID NO: 7786 - DNA, 144 bp, Homo sapiens; identical to SEQ ID NO: 2550
  chr5:37840076-37840220
  hyper

SEQ ID NO: 7787 - DNA, 96 bp, Homo sapiens; identical to SEQ ID NO: 2551
  chr5:37840267-37840363
  hyper

SEQ ID NO: 7788 - DNA, 187 bp, Homo sapiens; identical to SEQ ID NO: 2552
  chr5:37840529-37840716
  hyper

SEQ ID NO: 7789 - DNA, 90 bp, Homo sapiens
  chr5:38257451-38257541
  hyper
agccaggacgcccaccgagtcctggcagcgttgcaaggtggggagggggcgggcgcggtcctgtcgctagtgactgcagatttcctctgc

SEQ ID NO: 7790 - DNA, 64 bp, Homo sapiens
  chr5:38257542-38257606
  hyper
gggcacttcctacggcctttgatctttccccaggaactgccgagggccgcgtttgcctctaagt

SEQ ID NO: 7791 - DNA, 67 bp, Homo sapiens; identical to SEQ ID NO: 2553
  chr5:38257842-38257909
  hyper

SEQ ID NO: 7792 - DNA, 15 bp, Homo sapiens
  chr5:38257944-38257959
  hyper
cgccaggcttaactt

SEQ ID NO: 7793 - DNA, 496 bp, Homo sapiens
  chr5:38258174-38258670
  hyper
caaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcac

SEQ ID NO: 7794 - DNA, 144 bp, Homo sapiens
  chr5:38258671-38258815
  hyper
ccgacctcccggctgcagtcctacctcttggaactacccgtgtttccgggcccagccctcgcagccccccacctcctcgccccggcccggggatccgttggggccgcgtcccccacgcgcccccggagacgccctttccgtgtg

SEQ ID NO: 7795 - DNA, 123 bp, Homo sapiens
  chr5:38556551-38556674
  hyper
gggccgggcacaatgcgccgccgcctccgcagccgccgtctcgcctcccctgtgtcggcgcgaggctgcttgaggcggccacgggcgaagggcggcccgctgcgctccgcgaaccccgcgggc

SEQ ID NO: 7796 - DNA, 30 bp, Homo sapiens
  chr5:39425493-39425523
  hyper
tctgacaagggacaacggttcctgcgcaga

SEQ ID NO: 7797 - DNA, 15 bp, Homo sapiens
  chr5:40681213-40681228
  hyper
tggtgctgtgcaagt

SEQ ID NO: 7798 - DNA, 106 bp, Homo sapiens
  chr5:40681261-40681367
  hyper
cgctggtatgtgggctggctgtcaccgacctgttgggcactttgttggtgagcccggtgaccatcgccacgtacatgaagggccaatggcccgggggccagccgct

SEQ ID NO: 7799 - DNA, 164 bp, Homo sapiens
  chr5:40681676-40681840
  hyper
cctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgc

SEQ ID NO: 7800 - DNA, 487 bp, Homo sapiens
  chr5:42424672-42425159
  hyper
tgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtg

SEQ ID NO: 7801 - DNA, 207 bp, Homo sapiens; identical to SEQ ID NO: 432
  chr5:42951105-42951312
  hyper

SEQ ID NO: 7802 - DNA, 693 bp, Homo sapiens; identical to SEQ ID NO: 433
  chr5:42951419-42952112
  hyper

SEQ ID NO: 7803 - DNA, 457 bp, Homo sapiens; identical to SEQ ID NO: 434
  chr5:42991785-42992242
  hyper

SEQ ID NO: 7804 - DNA, 180 bp, Homo sapiens; identical to SEQ ID NO: 435
  chr5:42992375-42992555
  hyper

SEQ ID NO: 7805 - DNA, 42 bp, Homo sapiens; identical to SEQ ID NO: 436
  chr5:42992556-42992598
  hyper

SEQ ID NO: 7806 - DNA, 239 bp, Homo sapiens; identical to SEQ ID NO: 437
  chr5:42992782-42993021
  hyper

SEQ ID NO: 7807 - DNA, 240 bp, Homo sapiens; identical to SEQ ID NO: 438
  chr5:42993321-42993561
  hyper

SEQ ID NO: 7808 - DNA, 276 bp, Homo sapiens; identical to SEQ ID NO: 439
  chr5:42993861-42994137
  hyper

SEQ ID NO: 7809 - DNA, 679 bp, Homo sapiens
  chr5:43007818-43008497
  hyper
taagcatgcctgctgcggattaagagcgcgcatgcgcactgggggaatgggatggagccacccgggattctcgccttatacaaacagggaacccagcctccttagctttcatataaaagcctttgtattcagccgttaaggagcaaccggcaacctgctttcaggacccttgttttttatgagagctttcgtttacgcttaataaattctactccactcactcttcgatatccgcgtgcccacttcctcctgatcgtgagacaaggacccggatatagctgagcttagaagcaaaaatcctgcatcaatagcaaatgcggacactgaacgactagcggagtacccagcggcaaactttagtttttggtgcagttaaggtattgccactaagaaatcgtcgtctctgagaaatatcgaggcttggaaggttgtacagtgcttccaccgagaaagcacctacccaatgaaacgcctgtggcagaaaaaccgagcccaagcccttccagcgaaagtgctgaaagagcgcctcctcggccaatcactgggctgagaccgtgagacagccagcccggggaaagtggcggcgctaggagaggggaagcgttaccacaaagcacttctgagtcttgtgaacaagaaacgttctgggttgttttgtttttgagaaggagcctcgctc

SEQ ID NO: 7810 - DNA, 199 bp, Homo sapiens
  chr5:43008737-43008936
  hyper
gtgagccacagcgccccgccgaaacgttctgttgtgttcagcgcttccagcggtgcagcagccgagaaaacactgagtctccgctattggcgaaagtgctgatgcgaaactgctggctcgacataggcacagagccgcggaagagaaccctagagaccaggcaccagctctgctccccgactcacgggagaaagctagt

SEQ ID NO: 7811 - DNA, 224 bp, Homo sapiens; identical to SEQ ID NO: 2563
  chr5:43017953-43018177
  hyper

SEQ ID NO: 7812 - DNA, 325 bp, Homo sapiens; identical to SEQ ID NO: 2564
  chr5:43018326-43018651
  hyper

SEQ ID NO: 7813 - DNA, 156 bp, Homo sapiens; identical to SEQ ID NO: 2565
  chr5:43019191-43019347
  hyper

SEQ ID NO: 7814 - DNA, 78 bp, Homo sapiens
  chr5:43019809-43019887
  hyper
gtgacgtttcccattcgccaggtccttatgttctctgtgctgtcactttcttggttctcgcaccgctagtatctgcta

SEQ ID NO: 7815 - DNA, 147 bp, Homo sapiens
  chr5:43040869-43041016
  hyper
tactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgt

SEQ ID NO: 7816 - DNA, 238 bp, Homo sapiens
  chr5:43191854-43192092
  hyper
aacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatca

SEQ ID NO: 7817 - DNA, 470 bp, Homo sapiens
  chr5:43192670-43193140
  hyper
cagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 7818 - DNA, 261 bp, Homo sapiens
  chr5:43396969-43397230
  hyper
tgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactac

SEQ ID NO: 7819 - DNA, 72 bp, Homo sapiens
  chr5:43397305-43397377
  hyper
gcacgcctggacccgggggagccggctggggcgcccaggaccaggcctagcctaccgcgggctgcccttcac

SEQ ID NO: 7820 - DNA, 367 bp, Homo sapiens
  chr5:44388245-44388612
  hyper
gatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagagg

SEQ ID NO: 7821 - DNA, 30 bp, Homo sapiens
  chr5:44388856-44388886
  hyper
ggcaaggagagagctcgaggtggtggctgc

SEQ ID NO: 7822 - DNA, 311 bp, Homo sapiens
  chr5:44389793-44390104
  hyper
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcag

SEQ ID NO: 7823 - DNA, 15 bp, Homo sapiens
  chr5:45695225-45695240
  hyper
agcgaggataaccag

SEQ ID NO: 7824 - DNA, 295 bp, Homo sapiens
  chr5:45695313-45695608
  hyper
cgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacc

SEQ ID NO: 7825 - DNA, 28 bp, Homo sapiens
  chr5:45695936-45695964
  hyper
gcccctcggcgtcttcgaagccccccgc

SEQ ID NO: 7826 - DNA, 386 bp, Homo sapiens
  chr5:49736592-49736978
  hyper
ctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggaggg

SEQ ID NO: 7827 - DNA, 158 bp, Homo sapiens
  chr5:49737098-49737256
  hyper
cgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccg

SEQ ID NO: 7828 - DNA, 157 bp, Homo sapiens; identical to SEQ ID NO: 440
  chr5:50263484-50263641
  hyper

SEQ ID NO: 7829 - DNA, 142 bp, Homo sapiens; identical to SEQ ID NO: 2567
  chr5:50264500-50264642
  hyper

SEQ ID NO: 7830 - DNA, 347 bp, Homo sapiens
  chr5:50265325-50265672
  hyper
ctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 7831 - DNA, 160 bp, Homo sapiens
  chr5:50265720-50265880
  hyper
cggacttggcggggccggtccccacctgaagctcacctcaggcagtcgctagaagttccaatccaatcgtgagctttcctctgggagggacaggatccccttcaactcctgaggctgctcctctgggcgaatcccacagtaattgcgcatttctctccct

SEQ ID NO: 7832 - DNA, 40 bp, Homo sapiens
  chr5:50683270-50683310
  hyper
ctgtacttctctccccgctctgggccgcctccgctccccc

SEQ ID NO: 7833 - DNA, 229 bp, Homo sapiens
  chr5:50685846-50686075
  hyper
cgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtc

SEQ ID NO: 7834 - DNA, 7 bp, Homo sapiens
  chr5:50695234-50695241
  hyper
cacagac

SEQ ID NO: 7835 - DNA, 15 bp, Homo sapiens
  chr5:50695350-50695365
  hyper
cgccctcaggcccct

SEQ ID NO: 7836 - DNA, 347 bp, Homo sapiens; identical to SEQ ID NO: 441
  chr5:54516334-54516681
  hyper

SEQ ID NO: 7837 - DNA, 96 bp, Homo sapiens; identical to SEQ ID NO: 442
  chr5:54516831-54516927
  hyper

SEQ ID NO: 7838 - DNA, 156 bp, Homo sapiens; identical to SEQ ID NO: 443
  chr5:54519133-54519289
  hyper

SEQ ID NO: 7839 - DNA, 314 bp, Homo sapiens
  chr5:54527322-54527636
  hyper
cgcctccgggtggtctcccagtcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaagg

SEQ ID NO: 7840 - DNA, 449 bp, Homo sapiens
  chr5:57878091-57878540
  hyper
tttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 7841 - DNA, 35 bp, Homo sapiens
  chr5:57879028-57879063
  hyper
gccaacaatgagacacgaagcgcccatgcaggtgg

SEQ ID NO: 7842 - DNA, 149 bp, Homo sapiens
  chr5:58335677-58335826
  hyper
gagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctc

SEQ ID NO: 7843 - DNA, 62 bp, Homo sapiens
  chr5:59188996-59189058
  hyper
cctgagtccctggaacgaggagggccaggacatcctggatttcttcaggccgggccggtggc

SEQ ID NO: 7844 - DNA, 310 bp, Homo sapiens
  chr5:59189188-59189498
  hyper
cggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgct

SEQ ID NO: 7845 - DNA, 166 bp, Homo sapiens; identical to SEQ ID NO: 2571
  chr5:59189863-59190029
  hyper

SEQ ID NO: 7846 - DNA, 80 bp, Homo sapiens; identical to SEQ ID NO: 444
  chr5:63255163-63255243
  hyper

SEQ ID NO: 7847 - DNA, 395 bp, Homo sapiens; identical to SEQ ID NO: 2573
  chr5:63801877-63802272
  hyper

SEQ ID NO: 7848 - DNA, 32 bp, Homo sapiens; identical to SEQ ID NO: 2574
  chr5:63802273-63802305
  hyper

SEQ ID NO: 7849 - DNA, 166 bp, Homo sapiens; identical to SEQ ID NO: 2575
  chr5:63802339-63802505
  hyper

SEQ ID NO: 7850 - DNA, 78 bp, Homo sapiens
  chr5:63986450-63986528
  hyper
atgagcgaggccagccgactgtgctccggctactacagcctcaaccagagcttcgtggagcccttccagtgcccccgg

SEQ ID NO: 7851 - DNA, 112 bp, Homo sapiens
  chr5:63986569-63986681
  hyper
cgacctcaagtactgctgcagcgagccgggcagctacttcccctacaagcacagctacatgtggagcctcaggtgggctgagagcccgcgcgtgcggcggctggccgagccc

SEQ ID NO: 7852 - DNA, 53 bp, Homo sapiens
  chr5:63986909-63986962
  hyper
ccgcctggctggccccgctgagttccccgcccgcctcccgggagccgactgct

SEQ ID NO: 7853 - DNA, 132 bp, Homo sapiens
  chr5:67583945-67584077
  hyper
ctgtgcatagtgcctcgcttcactgtcggctacttgagccccgcgagccagccagcgcgctcagcagccagtgagactattttaggtcccctcacaatggccttctcatttcccaggcgaaaatgagcaagt

SEQ ID NO: 7854 - DNA, 194 bp, Homo sapiens; identical to SEQ ID NO: 2576
  chr5:71014720-71014914
  hyper

SEQ ID NO: 7855 - DNA, 359 bp, Homo sapiens
  chr5:71015180-71015539
  hyper
cctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctggg

SEQ ID NO: 7856 - DNA, 30 bp, Homo sapiens
  chr5:71403263-71403293
  hyper
cggagacagtaccttcggagataatccttt

SEQ ID NO: 7857 - DNA, 60 bp, Homo sapiens
  chr5:71403566-71403626
  hyper
acgcgcgctgggagacgcgcaaacacgaccccacccagggcgcgacggtcactgcgctcc

SEQ ID NO: 7858 - DNA, 30 bp, Homo sapiens
  chr5:71404019-71404049
  hyper
tcagcccctgagaaacgccttttctgattt

SEQ ID NO: 7859 - DNA, 30 bp, Homo sapiens
  chr5:71404812-71404842
  hyper
gcactgcggtctctacggcagcccgaggcg

SEQ ID NO: 7860 - DNA, 63 bp, Homo sapiens
  chr5:72416102-72416165
  hyper
gggggcatctcaactcgccggccccgccaggtgtgcgggccaggcagccgtggaaggtgccca

SEQ ID NO: 7861 - DNA, 15 bp, Homo sapiens
  chr5:72526051-72526066
  hyper
tcgccccagactgtc

SEQ ID NO: 7862 - DNA, 20 bp, Homo sapiens
  chr5:72526395-72526415
  hyper
gtgggcccaatgctccgggc

SEQ ID NO: 7863 - DNA, 156 bp, Homo sapiens
  chr5:72526491-72526647
  hyper
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagtta

SEQ ID NO: 7864 - DNA, 481 bp, Homo sapiens; identical to SEQ ID NO: 445
  chr5:72529345-72529826
  hyper

SEQ ID NO: 7865 - DNA, 374 bp, Homo sapiens; identical to SEQ ID NO: 446
  chr5:72529889-72530263
  hyper

SEQ ID NO: 7866 - DNA, 32 bp, Homo sapiens
  chr5:72530577-72530609
  hyper
ttccacccccacccccgcggaatgacagaaag

SEQ ID NO: 7867 - DNA, 35 bp, Homo sapiens; identical to SEQ ID NO: 447
  chr5:72594802-72594837
  hyper

SEQ ID NO: 7868 - DNA, 71 bp, Homo sapiens; identical to SEQ ID NO: 448
  chr5:72594867-72594938
  hyper

SEQ ID NO: 7869 - DNA, 282 bp, Homo sapiens
  chr5:72595440-72595722
  hyper
ttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcc

SEQ ID NO: 7870 - DNA, 15 bp, Homo sapiens
  chr5:72595773-72595788
  hyper
cgaaccaatgggcag

SEQ ID NO: 7871 - DNA, 30 bp, Homo sapiens
  chr5:72596861-72596891
  hyper
cacagagaggttgagcgttgccaaggactg

SEQ ID NO: 7872 - DNA, 72 bp, Homo sapiens
  chr5:72598030-72598102
  hyper
gcaatggaccatcaacgatcaagaaaaaaatacaaaggagaaatgaaatagctcatccgaaaagtcctactg

SEQ ID NO: 7873 - DNA, 383 bp, Homo sapiens; identical to SEQ ID NO: 449
  chr5:72599059-72599442
  hyper

SEQ ID NO: 7874 - DNA, 371 bp, Homo sapiens; identical to SEQ ID NO: 450
  chr5:72599462-72599833
  hyper

SEQ ID NO: 7875 - DNA, 30 bp, Homo sapiens
  chr5:72608427-72608457
  hyper
gggaagctgtgcctccgcaaacacagccca

SEQ ID NO: 7876 - DNA, 83 bp, Homo sapiens
  chr5:72715590-72715673
  hyper
cggcccgggggagggcgaggcccggctgcctgcgctcgcgttcccaggccctcggaaccgcgcgccctcgaggccgagcgagc

SEQ ID NO: 7877 - DNA, 40 bp, Homo sapiens
  chr5:72716058-72716098
  hyper
atgtcccctaaagcacgggaagcttcgtgttttatgtttg

SEQ ID NO: 7878 - DNA, 30 bp, Homo sapiens
  chr5:72733093-72733123
  hyper
tcagacaggggagtgcggtggagtttatgc

SEQ ID NO: 7879 - DNA, 30 bp, Homo sapiens
  chr5:72733558-72733588
  hyper
agaggccgagcctcccgctcctgttgccat

SEQ ID NO: 7880 - DNA, 46 bp, Homo sapiens
  chr5:72740138-72740184
  hyper
cccatccagggtccacggctcactcgtccctcgcctgccccgcggc

SEQ ID NO: 7881 - DNA, 232 bp, Homo sapiens
  chr5:72742850-72743082
  hyper
gcagagtccccaaggcggcggacgaggagactgaggaggcggcggcggccgcggcggccacgagggatcgggtgagcgcggccgccgggcccacggccgcctgcgccgcgcagcctcctccgctggatccgggagctggcggcgccgccaccggcgagggcgagggcgaggcctgagcggcggcggcggcctgcgcggcggcggcggcagcggcggccgggcccaagctgcc

SEQ ID NO: 7882 - DNA, 51 bp, Homo sapiens
  chr5:72743504-72743555
  hyper
gggagcagcggctgccgcttgaagcgcttcctccggcgcaggaagctgccg

SEQ ID NO: 7883 - DNA, 171 bp, Homo sapiens
  chr5:72744287-72744458
  hyper
gcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgacct

SEQ ID NO: 7884 - DNA, 32 bp, Homo sapiens
  chr5:72744886-72744918
  hyper
cctcagaagcacacccgcgacactctggtttg

SEQ ID NO: 7885 - DNA, 53 bp, Homo sapiens
  chr5:74162540-74162593
  hyper
gcaacgctgattttgcgtattcctttaatgccgaccttcgcaggattctgttc

SEQ ID NO: 7886 - DNA, 302 bp, Homo sapiens
  chr5:75377939-75378241
  hyper
caggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaa

SEQ ID NO: 7887 - DNA, 148 bp, Homo sapiens
  chr5:75379107-75379255
  hyper
gggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggg

SEQ ID NO: 7888 - DNA, 126 bp, Homo sapiens; identical to SEQ ID NO: 2583
  chr5:75380067-75380193
  hyper

SEQ ID NO: 7889 - DNA, 452 bp, Homo sapiens; identical to SEQ ID NO: 2584
  chr5:75380422-75380874
  hyper

SEQ ID NO: 7890 - DNA, 47 bp, Homo sapiens
  chr5:76011307-76011354
  hyper
tgaaacgcctaacttcgcgaaataaagagagacgtataaaagttcaa

SEQ ID NO: 7891 - DNA, 92 bp, Homo sapiens; identical to SEQ ID NO: 451
  chr5:76249579-76249671
  hyper

SEQ ID NO: 7892 - DNA, 212 bp, Homo sapiens; identical to SEQ ID NO: 452
  chr5:76249695-76249907
  hyper

SEQ ID NO: 7893 - DNA, 174 bp, Homo sapiens; identical to SEQ ID NO: 453
  chr5:76249944-76250118
  hyper

SEQ ID NO: 7894 - DNA, 211 bp, Homo sapiens
  chr5:76506548-76506759
  hyper
ggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 7895 - DNA, 366 bp, Homo sapiens
  chr5:76506760-76507126
  hyper
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgt

SEQ ID NO: 7896 - DNA, 345 bp, Homo sapiens; identical to SEQ ID NO: 454
  chr5:76923679-76924024
  hyper

SEQ ID NO: 7897 - DNA, 214 bp, Homo sapiens; identical to SEQ ID NO: 455
  chr5:76924086-76924300
  hyper

SEQ ID NO: 7898 - DNA, 133 bp, Homo sapiens
  chr5:76924754-76924887
  hyper
ttcattcttagaaagcgcttctgttctctgggtttggatttgaccagcacatgcagaaagagctgattgtgtttctctgtacaaagttgcagggttgtagatgtccgagtgcccccatcggctgccagcaggt

SEQ ID NO: 7899 - DNA, 425 bp, Homo sapiens
  chr5:76925464-76925889
  hyper
tgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaa

SEQ ID NO: 7900 - DNA, 326 bp, Homo sapiens
  chr5:76926106-76926432
  hyper
gactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 7901 - DNA, 262 bp, Homo sapiens; identical to SEQ ID NO: 2590
  chr5:76928678-76928940
  hyper

SEQ ID NO: 7902 - DNA, 984 bp, Homo sapiens; identical to SEQ ID NO: 2591
  chr5:76932282-76933266
  hyper

SEQ ID NO: 7903 - DNA, 30 bp, Homo sapiens
  chr5:76933489-76933519
  hyper
cctccggccctcagccgattccctcttact

SEQ ID NO: 7904 - DNA, 47 bp, Homo sapiens
  chr5:76934057-76934104
  hyper
gggtatatcgcctttcgaaaaaaaaaaaaaggcgggggaggggggaa

SEQ ID NO: 7905 - DNA, 323 bp, Homo sapiens; identical to SEQ ID NO: 456
  chr5:76934331-76934654
  hyper

SEQ ID NO: 7906 - DNA, 194 bp, Homo sapiens; identical to SEQ ID NO: 457
  chr5:76934676-76934870
  hyper

SEQ ID NO: 7907 - DNA, 602 bp, Homo sapiens; identical to SEQ ID NO: 458
  chr5:76936119-76936721
  hyper

SEQ ID NO: 7908 - DNA, 94 bp, Homo sapiens
  chr5:76939648-76939742
  hyper
cacccagaagcctttcgcaatacacgagctcgacatatacacttttttcttttctgcagtaaacagtttcccacacattcgagtttgcaaactt

SEQ ID NO: 7909 - DNA, 30 bp, Homo sapiens
  chr5:76940379-76940409
  hyper
cccgcccggctcctacgtcccaatcctttt

SEQ ID NO: 7910 - DNA, 97 bp, Homo sapiens
  chr5:76940857-76940954
  hyper
ccctcgtcccctccccgcaacccgagtgcggctaattccgggcgtctatattcactcaattagagaaatctacagagaagatcgatcttccatctgc

SEQ ID NO: 7911 - DNA, 306 bp, Homo sapiens
  chr5:76941192-76941498
  hyper
ccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 7912 - DNA, 389 bp, Homo sapiens
  chr5:76941512-76941901
  hyper
cgcggcctcctcccggcgtctcccgcgccgtcgggccgggcgggggacacaagccgccgcagcggctagggggccccgccagcccggcccgctccgcctcggctgggcggccgggttggcacaagcaactgccaggcccccgaacactggagaagccggcccgagggaggggcccttgcctggggcgggtgccgagggtcagtccaggaaacttctggaacaggtggaagtcctcccgggtagatgtgagctccatcgggaaaagggtgtcacaaaaacaggtgctcagaggcaggggtgccaccgcggcaccccagaaccccgggtcagctcgcgcggacaccgcgtctgggagtcctggcgtggaagggcctcgggggttctcattc

SEQ ID NO: 7913 - DNA, 182 bp, Homo sapiens; identical to SEQ ID NO: 459
  chr5:77140529-77140711
  hyper

SEQ ID NO: 7914 - DNA, 101 bp, Homo sapiens; identical to SEQ ID NO: 460
  chr5:77147549-77147650
  hyper

SEQ ID NO: 7915 - DNA, 260 bp, Homo sapiens; identical to SEQ ID NO: 461
  chr5:77147872-77148132
  hyper

SEQ ID NO: 7916 - DNA, 280 bp, Homo sapiens; identical to SEQ ID NO: 462
  chr5:77148393-77148673
  hyper

SEQ ID NO: 7917 - DNA, 367 bp, Homo sapiens; identical to SEQ ID NO: 463
  chr5:77268367-77268734
  hyper

SEQ ID NO: 7918 - DNA, 227 bp, Homo sapiens; identical to SEQ ID NO: 464
  chr5:77268735-77268962
  hyper

SEQ ID NO: 7919 - DNA, 49 bp, Homo sapiens
  chr5:77269263-77269312
  hyper
cgccagcaccaggggcgggctggagggggaccggcgatcagggaaacct

SEQ ID NO: 7920 - DNA, 43 bp, Homo sapiens
  chr5:78408232-78408275
  hyper
agcgccctctgcacccggcgcgcccagaacagggaggagtgca

SEQ ID NO: 7921 - DNA, 32 bp, Homo sapiens
  chr5:78408297-78408329
  hyper
cgcctggatctgcaccgcgggtgtcggggccg

SEQ ID NO: 7922 - DNA, 196 bp, Homo sapiens
  chr5:79330939-79331135
  hyper
cttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggcc

SEQ ID NO: 7923 - DNA, 108 bp, Homo sapiens
  chr5:79331229-79331337
  hyper
ggacgccgagcacgggtcacctgcggcgccggcccgggcgccgaccgaggttcaacgcacggcccggggacccccaggcggggccaacgccgccgtcgcccccggcct

SEQ ID NO: 7924 - DNA, 3 bp, Homo sapiens
  chr5:79331476-79331479
  hyper
cgc

SEQ ID NO: 7925 - DNA, 583 bp, Homo sapiens; identical to SEQ ID NO: 2601
  chr5:79864862-79865445
  hyper

SEQ ID NO: 7926 - DNA, 71 bp, Homo sapiens; identical to SEQ ID NO: 2602
  chr5:79865522-79865593
  hyper

SEQ ID NO: 7927 - DNA, 315 bp, Homo sapiens; identical to SEQ ID NO: 2603
  chr5:79866099-79866414
  hyper

SEQ ID NO: 7928 - DNA, 300 bp, Homo sapiens
  chr5:80255775-80256075
  hyper
ttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgc

SEQ ID NO: 7929 - DNA, 58 bp, Homo sapiens
  chr5:80256312-80256370
  hyper
gggggctcggccgggagggtggtggttagggcggagagcgtgcctcggccccagcccg

SEQ ID NO: 7930 - DNA, 91 bp, Homo sapiens
  chr5:80256428-80256519
  hyper
cgtggggaaagggggcgcccttcgccggccgggacctgagcggtcgcgccctcgagggagccagctgggccatggccgcgaggcaggggtg

SEQ ID NO: 7931 - DNA, 105 bp, Homo sapiens; identical to SEQ ID NO: 2604
  chr5:80689690-80689795
  hyper

SEQ ID NO: 7932 - DNA, 92 bp, Homo sapiens
  chr5:80690062-80690154
  hyper
aggtggtgggagctgcgagtgagggggcccgcactgtcatcccaggactatcgcgagtgggggaaaaccagcgctctcgggtctcaggagaa

SEQ ID NO: 7933 - DNA, 30 bp, Homo sapiens
  chr5:81075100-81075130
  hyper
cctgacctgcagctccgcagaattccaaac

SEQ ID NO: 7934 - DNA, 37 bp, Homo sapiens
  chr5:82767171-82767208
  hyper
ccagaactagctgcacggggggcggggaaatgggggt

SEQ ID NO: 7935 - DNA, 364 bp, Homo sapiens; identical to SEQ ID NO: 465
  chr5:82767429-82767793
  hyper

SEQ ID NO: 7936 - DNA, 156 bp, Homo sapiens
  chr5:82768425-82768581
  hyper
ctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcag

SEQ ID NO: 7937 - DNA, 110 bp, Homo sapiens
  chr5:82769171-82769281
  hyper
ccctgggagatgctgcgggaagggggagaaatctacacggcgcctggagagttgtcctgccgcgcgcacacccgcggcagagtctctctgggtcgcgttcctcatctttg

SEQ ID NO: 7938 - DNA, 41 bp, Homo sapiens
  chr5:82769910-82769951
  hyper
accacttgaacccaacgctagggccccgccccaggatattg

SEQ ID NO: 7939 - DNA, 30 bp, Homo sapiens
  chr5:83679177-83679207
  hyper
ggacaagctgcacctcgcaggggacctgga

SEQ ID NO: 7940 - DNA, 34 bp, Homo sapiens
  chr5:83679766-83679800
  hyper
gtctgcagtcagcatcgcccgcactgcctaggga

SEQ ID NO: 7941 - DNA, 82 bp, Homo sapiens
  chr5:83680216-83680298
  hyper
cggctggtcaggggtcgtcgcggagggcagtgtagccgaggtggcagcgcagggcagcagcagactccgcccctactaaaga

SEQ ID NO: 7942 - DNA, 63 bp, Homo sapiens; identical to SEQ ID NO: 466
  chr5:87955602-87955665
  hyper

SEQ ID NO: 7943 - DNA, 495 bp, Homo sapiens; identical to SEQ ID NO: 467
  chr5:87956168-87956663
  hyper

SEQ ID NO: 7944 - DNA, 427 bp, Homo sapiens; identical to SEQ ID NO: 468
  chr5:87956679-87957106
  hyper

SEQ ID NO: 7945 - DNA, 30 bp, Homo sapiens
  chr5:87963456-87963486
  hyper
aattgtggaccagcccggcaaggtcaaagg

SEQ ID NO: 7946 - DNA, 304 bp, Homo sapiens; identical to SEQ ID NO: 469
  chr5:87967773-87968077
  hyper

SEQ ID NO: 7947 - DNA, 11 bp, Homo sapiens
  chr5:87968675-87968686
  hyper
gcaccggctag

SEQ ID NO: 7948 - DNA, 86 bp, Homo sapiens; identical to SEQ ID NO: 471
  chr5:87968772-87968858
  hyper

SEQ ID NO: 7949 - DNA, 73 bp, Homo sapiens; identical to SEQ ID NO: 472
  chr5:87970041-87970114
  hyper

SEQ ID NO: 7950 - DNA, 792 bp, Homo sapiens; identical to SEQ ID NO: 473
  chr5:87970115-87970907
  hyper

SEQ ID NO: 7951 - DNA, 318 bp, Homo sapiens
  chr5:87971517-87971835
  hyper
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacat

SEQ ID NO: 7952 - DNA, 374 bp, Homo sapiens
  chr5:87974084-87974458
  hyper
aatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaac

SEQ ID NO: 7953 - DNA, 100 bp, Homo sapiens
  chr5:87979725-87979825
  hyper
acttaaaagcccttgcgactccctctgaattcttagttacttatgacggccttcctcactgcacatagcccctggggtgtgtgtgtgtgtgtgtgtgtgt

SEQ ID NO: 7954 - DNA, 100 bp, Homo sapiens
  chr5:87979885-87979985
  hyper
gtgtgtttaaaacgcttattggtaggtcatcagcagctgatcagacatggtaatccaataatttttttgaatacacacaatttttcgttgaagttaattt

SEQ ID NO: 7955 - DNA, 30 bp, Homo sapiens
  chr5:87985488-87985518
  hyper
aggactcatctgccgcggggctgccggaag

SEQ ID NO: 7956 - DNA, 69 bp, Homo sapiens
  chr5:87985975-87986044
  hyper
taagagctctagaggcgcctcttccactcactagggcaccatgtcaaagggactcgtcatggcgattta

SEQ ID NO: 7957 - DNA, 68 bp, Homo sapiens
  chr5:87988516-87988584
  hyper
gtctcgcagtaggctcgggtcacaggagggagggggtaggggttcagctccgccgaaagagttagcta

SEQ ID NO: 7958 - DNA, 124 bp, Homo sapiens; identical to SEQ ID NO: 474
  chr5:88185263-88185387
  hyper

SEQ ID NO: 7959 - DNA, 399 bp, Homo sapiens; identical to SEQ ID NO: 475
  chr5:88185388-88185787
  hyper

SEQ ID NO: 7960 - DNA, 386 bp, Homo sapiens
  chr5:89854523-89854909
  hyper
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcat

SEQ ID NO: 7961 - DNA, 26 bp, Homo sapiens
  chr5:92915099-92915125
  hyper
cgctagggtcacgccgggtcccaggg

SEQ ID NO: 7962 - DNA, 12 bp, Homo sapiens
  chr5:92940177-92940189
  hyper
ggggtgggccgg

SEQ ID NO: 7963 - DNA, 73 bp, Homo sapiens
  chr5:94621061-94621134
  hyper
actgagcgatgaacccgacggagttctaaagctgaagacgtctgcccccgccccgttgcgctccctgggtcca

SEQ ID NO: 7964 - DNA, 545 bp, Homo sapiens
  chr5:94955615-94956160
  hyper
ggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaaca

SEQ ID NO: 7965 - DNA, 486 bp, Homo sapiens
  chr5:94956606-94957092
  hyper
gcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggc

SEQ ID NO: 7966 - DNA, 59 bp, Homo sapiens; identical to SEQ ID NO: 2617
  chr5:95769034-95769093
  hyper

SEQ ID NO: 7967 - DNA, 416 bp, Homo sapiens
  chr5:100236552-100236968
  hyper
tcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctc

SEQ ID NO: 7968 - DNA, 59 bp, Homo sapiens
  chr5:100237658-100237717
  hyper
gtttctgatagaggacgcctccaaaccggaacagggaggatttccgaaacaggactttg

SEQ ID NO: 7969 - DNA, 30 bp, Homo sapiens
  chr5:100238368-100238398
  hyper
cagcttagagaagcacgcacatctcaacaa

SEQ ID NO: 7970 - DNA, 95 bp, Homo sapiens; identical to SEQ ID NO: 2618
  chr5:100238882-100238977
  hyper

SEQ ID NO: 7971 - DNA, 44 bp, Homo sapiens; identical to SEQ ID NO: 2619
  chr5:100238978-100239022
  hyper

SEQ ID NO: 7972 - DNA, 97 bp, Homo sapiens; identical to SEQ ID NO: 2620
  chr5:100239023-100239120
  hyper

SEQ ID NO: 7973 - DNA, 590 bp, Homo sapiens; identical to SEQ ID NO: 2621
  chr5:100239134-100239724
  hyper

SEQ ID NO: 7974 - DNA, 141 bp, Homo sapiens
  chr5:107005171-107005312
  hyper
gaagcaataaaggttcggaactgctccagacccggaggaccccgccgggcactctggataacctccccactccacttccagggtccgaaaacacgggacgtctgcgactggccggtgtccagcacgcgcactaggaccgcc

SEQ ID NO: 7975 - DNA, 479 bp, Homo sapiens
  chr5:110408719-110409198
  hyper
gaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgc

SEQ ID NO: 7976 - DNA, 46 bp, Homo sapiens
  chr5:110560287-110560333
  hyper
gctccaacagggatgcgctgagcgatttcttcgaggtggagtcgga

SEQ ID NO: 7977 - DNA, 248 bp, Homo sapiens; identical to SEQ ID NO: 476
  chr5:112629488-112629736
  hyper

SEQ ID NO: 7978 - DNA, 34 bp, Homo sapiens
  chr5:112824097-112824131
  hyper
gcggccgccatcatgcgcccgctccctacttggg

SEQ ID NO: 7979 - DNA, 19 bp, Homo sapiens
  chr5:113391755-113391774
  hyper
gggagtccccagtcccggc

SEQ ID NO: 7980 - DNA, 184 bp, Homo sapiens
  chr5:113391775-113391959
  hyper
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagcc

SEQ ID NO: 7981 - DNA, 229 bp, Homo sapiens
  chr5:113696982-113697211
  hyper
gcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcg

SEQ ID NO: 7982 - DNA, 251 bp, Homo sapiens
  chr5:113697471-113697722
  hyper
agcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctacc

SEQ ID NO: 7983 - DNA, 87 bp, Homo sapiens
  chr5:113698053-113698140
  hyper
cctcctccggtgccccggcggcgggggcgggagataacctgtccctgctgctccgcacctcctcgcccggcggcgccttccggaccc

SEQ ID NO: 7984 - DNA, 7 bp, Homo sapiens
  chr5:113698141-113698148
  hyper
cacctcc

SEQ ID NO: 7985 - DNA, 192 bp, Homo sapiens
  chr5:113698392-113698584
  hyper
accaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccg

SEQ ID NO: 7986 - DNA, 30 bp, Homo sapiens
  chr5:113698669-113698699
  hyper
cgtggtgtctaagcccgagcacaacaactc

SEQ ID NO: 7987 - DNA, 156 bp, Homo sapiens
  chr5:113699401-113699557
  hyper
ttccaggtctactctcgtctcttttggttttgaggccgagtgatctgacagatcacagagccaagacaggtgcacccctctccccttatcttccttctgtgagttcaggtccacctgtgggggactgactgactctggggacgtggaaggcggtta

SEQ ID NO: 7988 - DNA, 571 bp, Homo sapiens; identical to SEQ ID NO: 2623
  chr5:114515009-114515580
  hyper

SEQ ID NO: 7989 - DNA, 61 bp, Homo sapiens; identical to SEQ ID NO: 2624
  chr5:114515610-114515671
  hyper

SEQ ID NO: 7990 - DNA, 168 bp, Homo sapiens
  chr5:114515948-114516116
  hyper
aggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaac

SEQ ID NO: 7991 - DNA, 173 bp, Homo sapiens; identical to SEQ ID NO: 477
  chr5:115151185-115151358
  hyper

SEQ ID NO: 7992 - DNA, 736 bp, Homo sapiens; identical to SEQ ID NO: 478
  chr5:115151649-115152385
  hyper

SEQ ID NO: 7993 - DNA, 61 bp, Homo sapiens; identical to SEQ ID NO: 479
  chr5:115152616-115152677
  hyper

SEQ ID NO: 7994 - DNA, 47 bp, Homo sapiens; identical to SEQ ID NO: 2628
  chr5:115297186-115297233
  hyper

SEQ ID NO: 7995 - DNA, 30 bp, Homo sapiens
  chr5:115297472-115297502
  hyper
cccttcttgtggtaacgcggtcctaaccct

SEQ ID NO: 7996 - DNA, 45 bp, Homo sapiens
  chr5:115297941-115297986
  hyper
cacgtttaaggtgtccggattcgtttggcttgaccaccccctccc

SEQ ID NO: 7997 - DNA, 260 bp, Homo sapiens
  chr5:115298781-115299041
  hyper
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcgg

SEQ ID NO: 7998 - DNA, 30 bp, Homo sapiens
  chr5:115911931-115911961
  hyper
gctgtcagcaggggccgctatccccacctt

SEQ ID NO: 7999 - DNA, 30 bp, Homo sapiens
  chr5:119800264-119800294
  hyper
acagatcaagatcatcgtggaggatttgga

SEQ ID NO: 8000 - DNA, 326 bp, Homo sapiens
  chr5:119800576-119800902
  hyper
ggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagc

SEQ ID NO: 8001 - DNA, 312 bp, Homo sapiens; identical to SEQ ID NO: 2629
  chr5:119801156-119801468
  hyper

SEQ ID NO: 8002 - DNA, 81 bp, Homo sapiens
  chr5:121412825-121412906
  hyper
caagagaactggggacgcccgggactgcaaagcaatgtgaaaaggaagcaggaggggccagacgcgcggtttgcactggat

SEQ ID NO: 8003 - DNA, 148 bp, Homo sapiens
  chr5:121413157-121413305
  hyper
aggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttg

SEQ ID NO: 8004 - DNA, 55 bp, Homo sapiens
  chr5:121647480-121647535
  hyper
aagaaagagcaggttcgtggacaggagccggcgggcaggccgggggatccctggt

SEQ ID NO: 8005 - DNA, 35 bp, Homo sapiens
  chr5:122422616-122422651
  hyper
ttcttccctggaccccgcagcgaggggaaccaaat

SEQ ID NO: 8006 - DNA, 48 bp, Homo sapiens; identical to SEQ ID NO: 2630
  chr5:122423328-122423376
  hyper

SEQ ID NO: 8007 - DNA, 154 bp, Homo sapiens
  chr5:122423874-122424028
  hyper
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcgg

SEQ ID NO: 8008 - DNA, 78 bp, Homo sapiens
  chr5:122424436-122424514
  hyper
caggaaaaactgagccgggcaaaagcgcaaacccggtcctggcggcgcgggcttgctccagcgcggacaccacagcgt

SEQ ID NO: 8009 - DNA, 166 bp, Homo sapiens
  chr5:122425166-122425332
  hyper
gctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 8010 - DNA, 79 bp, Homo sapiens
  chr5:122425562-122425641
  hyper
agggagccgcggaaccgggcggccgccggctgaaccaccggctcgggcactttctccagggtcccagtggccctcttcc

SEQ ID NO: 8011 - DNA, 162 bp, Homo sapiens
  chr5:122425701-122425863
  hyper
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagc

SEQ ID NO: 8012 - DNA, 182 bp, Homo sapiens
  chr5:122426164-122426346
  hyper
tggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgcc

SEQ ID NO: 8013 - DNA, 44 bp, Homo sapiens
  chr5:122426805-122426849
  hyper
gggttgtgggggaaccggcgggagctgttcgctggccaggcctc

SEQ ID NO: 8014 - DNA, 80 bp, Homo sapiens
  chr5:122430755-122430835
  hyper
gccgccccgcagggtcgagactgaaatcaattggctccccttccggcggccaggcaaacctgcctcgcctctggatctgc

SEQ ID NO: 8015 - DNA, 268 bp, Homo sapiens
  chr5:122431118-122431386
  hyper
ggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggctt

SEQ ID NO: 8016 - DNA, 28 bp, Homo sapiens
  chr5:122434500-122434528
  hyper
tccagaacagcaccccggtcccccaccc

SEQ ID NO: 8017 - DNA, 15 bp, Homo sapiens
  chr5:122434605-122434620
  hyper
cgcccttggagtcct

SEQ ID NO: 8018 - DNA, 311 bp, Homo sapiens
  chr5:125930586-125930897
  hyper
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagc

SEQ ID NO: 8019 - DNA, 96 bp, Homo sapiens
  chr5:126626514-126626610
  hyper
cagcaagtactttcccggtgcgcaaaactgggcgactgggaacgcgttgagacgttcctctttcccgcttctccacctttacgcctgaaagaagac

SEQ ID NO: 8020 - DNA, 48 bp, Homo sapiens
  chr5:127872942-127872990
  hyper
ctaaagggtctgggacggagtgggccagaaagccgccaaactgaggat

SEQ ID NO: 8021 - DNA, 102 bp, Homo sapiens; identical to SEQ ID NO: 480
  chr5:127873552-127873654
  hyper

SEQ ID NO: 8022 - DNA, 295 bp, Homo sapiens; identical to SEQ ID NO: 2632
  chr5:127874183-127874478
  hyper

SEQ ID NO: 8023 - DNA, 238 bp, Homo sapiens; identical to SEQ ID NO: 2633
  chr5:127874705-127874943
  hyper

SEQ ID NO: 8024 - DNA, 40 bp, Homo sapiens
  chr5:128300655-128300695
  hyper
tggatgacctttgtgcgacactgttataccttatcagcct

SEQ ID NO: 8025 - DNA, 82 bp, Homo sapiens
  chr5:128300712-128300794
  hyper
cgcccaatcccagcaactctggttctcctgtgaccccaagccttccagatccctgggtttccccccacgggactgtcacatt

SEQ ID NO: 8026 - DNA, 193 bp, Homo sapiens
  chr5:128301033-128301226
  hyper
tcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagccc

SEQ ID NO: 8027 - DNA, 355 bp, Homo sapiens; identical to SEQ ID NO: 2634
  chr5:128795742-128796097
  hyper

SEQ ID NO: 8028 - DNA, 366 bp, Homo sapiens; identical to SEQ ID NO: 2635
  chr5:128796098-128796464
  hyper

SEQ ID NO: 8029 - DNA, 654 bp, Homo sapiens
  chr5:128796816-128797470
  hyper
cgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 8030 - DNA, 37 bp, Homo sapiens
  chr5:129241413-129241450
  hyper
gcttctctgccagcacgtgcttcgggctcccacaggc

SEQ ID NO: 8031 - DNA, 338 bp, Homo sapiens
  chr5:131346877-131347215
  hyper
gggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagaggg

SEQ ID NO: 8032 - DNA, 30 bp, Homo sapiens
  chr5:131593289-131593319
  hyper
gggcgggggctgggccgagtggggacaggg

SEQ ID NO: 8033 - DNA, 139 bp, Homo sapiens
  chr5:131992154-131992293
  hyper
ccacccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 8034 - DNA, 65 bp, Homo sapiens
  chr5:132947112-132947177
  hyper
tccccaaactcgaggcgacaggcgccgaaagcagagtgctgtgcctgcctcgtccaggtccctcc

SEQ ID NO: 8035 - DNA, 967 bp, Homo sapiens
  chr5:132947562-132948529
  hyper
gcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 8036 - DNA, 107 bp, Homo sapiens
  chr5:133449736-133449843
  hyper
cctgactgaggggcccgtcacagatgtgtgatgtataagctctgcacgcaacaggagctcaataaatgtgcgaaggggggtatacttatgttcgcactgtatgcagg

SEQ ID NO: 8037 - DNA, 53 bp, Homo sapiens
  chr5:134367150-134367203
  hyper
ccgcaccactgtcctcgggccccttgggttccccgccgcgctccttctctgca

SEQ ID NO: 8038 - DNA, 667 bp, Homo sapiens; identical to SEQ ID NO: 2636
  chr5:134374791-134375458
  hyper

SEQ ID NO: 8039 - DNA, 112 bp, Homo sapiens; identical to SEQ ID NO: 481
  chr5:134385952-134386064
  hyper

SEQ ID NO: 8040 - DNA, 39 bp, Homo sapiens
  chr5:134825463-134825502
  hyper
agcgctgcacaaaatcgtctagcgcggagcagggcgggg

SEQ ID NO: 8041 - DNA, 94 bp, Homo sapiens
  chr5:134825912-134826006
  hyper
ggagaggcccccgggacctttcaggcccacaaacgccgcgctaaatagccacgcgcacaatagcatgaaagggctcactcggaccttactgcaa

SEQ ID NO: 8042 - DNA, 392 bp, Homo sapiens
  chr5:134870528-134870920
  hyper
cggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcc

SEQ ID NO: 8043 - DNA, 96 bp, Homo sapiens
  chr5:134871789-134871885
  hyper
tgcataatttatgctcgcgggaggccgccatcgcccctcccccaacccggagtgtgcccgtaattaccgccggccaatcggcggcgtcgcgcggcc

SEQ ID NO: 8044 - DNA, 512 bp, Homo sapiens; identical to SEQ ID NO: 482
  chr5:134879478-134879990
  hyper

SEQ ID NO: 8045 - DNA, 180 bp, Homo sapiens
  chr5:134914251-134914431
  hyper
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgcca

SEQ ID NO: 8046 - DNA, 51 bp, Homo sapiens
  chr5:134914701-134914752
  hyper
ggcctcttttaaatccgctcctgccctcgcagcgagcgagctcattaatat

SEQ ID NO: 8047 - DNA, 37 bp, Homo sapiens
  chr5:135170325-135170362
  hyper
gggcgtgatgtcagccgccctccggcacttggagagg

SEQ ID NO: 8048 - DNA, 30 bp, Homo sapiens
  chr5:135171026-135171056
  hyper
cccaacggggcgtcccgactggagggagca

SEQ ID NO: 8049 - DNA, 123 bp, Homo sapiens; identical to SEQ ID NO: 483
  chr5:135265737-135265860
  hyper

SEQ ID NO: 8050 - DNA, 12 bp, Homo sapiens
  chr5:135265919-135265931
  hyper
cgccaggtgggc

SEQ ID NO: 8051 - DNA, 197 bp, Homo sapiens; identical to SEQ ID NO: 485
  chr5:135265932-135266129
  hyper

SEQ ID NO: 8052 - DNA, 110 bp, Homo sapiens; identical to SEQ ID NO: 486
  chr5:135266577-135266687
  hyper

SEQ ID NO: 8053 - DNA, 49 bp, Homo sapiens
  chr5:135527945-135527994
  hyper
gcggtcgtggggcagcgcggcgaaggccgaatggcgcagctggcaaccg

SEQ ID NO: 8054 - DNA, 431 bp, Homo sapiens
  chr5:135528223-135528654
  hyper
cccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctga

SEQ ID NO: 8055 - DNA, 18 bp, Homo sapiens
  chr5:136834033-136834051
  hyper
cccagggccgggtggcgc

SEQ ID NO: 8056 - DNA, 108 bp, Homo sapiens; identical to SEQ ID NO: 2644
  chr5:136834289-136834397
  hyper

SEQ ID NO: 8057 - DNA, 53 bp, Homo sapiens
  chr5:136834828-136834881
  hyper
tactccaagttggggcgcggggttcctctgggcacgtaccttgggggccggcc

SEQ ID NO: 8058 - DNA, 7 bp, Homo sapiens
  chr5:136834912-136834919
  hyper
cgcggca

SEQ ID NO: 8059 - DNA, 38 bp, Homo sapiens
  chr5:137225091-137225129
  hyper
cgtcagagccgggcagcgcgcgccgcaagactagcgcg

SEQ ID NO: 8060 - DNA, 86 bp, Homo sapiens
  chr5:137577679-137577765
  hyper
gccagccccgtgccccgggcggccgctgatagtcggctaatgcgtatcgaatttttgtggagttcggcccgcgcagagtgcgcgcg

SEQ ID NO: 8061 - DNA, 81 bp, Homo sapiens
  chr5:139048090-139048171
  hyper
ggcccgaggtgatggcggctgttcctgccgttctggggcctgtgccccagagctggccgcgtttctcggggcgggagccag

SEQ ID NO: 8062 - DNA, 44 bp, Homo sapiens
  chr5:139175833-139175877
  hyper
gcccagcctgagggacggtgggggctgccgggccgattgtctcc

SEQ ID NO: 8063 - DNA, 21 bp, Homo sapiens
  chr5:139175929-139175950
  hyper
cgtgtgcgtggggggtgccag

SEQ ID NO: 8064 - DNA, 159 bp, Homo sapiens; identical to SEQ ID NO: 2645
  chr5:139227762-139227921
  hyper

SEQ ID NO: 8065 - DNA, 335 bp, Homo sapiens
  chr5:139525423-139525758
  hyper
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggcctaggggtggggggccgtaggtgctgcgcg

SEQ ID NO: 8066 - DNA, 93 bp, Homo sapiens
  chr5:140012165-140012258
  hyper
gcggaggcatggtgccggttatctttaggtcctcgagcgtcagttccttgaggcgggagtacgctagcacacgcagggcgcctaccagtagct

SEQ ID NO: 8067 - DNA, 52 bp, Homo sapiens; identical to SEQ ID NO: 2646
  chr5:140187094-140187146
  hyper

SEQ ID NO: 8068 - DNA, 245 bp, Homo sapiens
  chr5:140305805-140306050
  hyper
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaa

SEQ ID NO: 8069 - DNA, 176 bp, Homo sapiens
  chr5:140306444-140306620
  hyper
cgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggc

SEQ ID NO: 8070 - DNA, 59 bp, Homo sapiens
  chr5:140306674-140306733
  hyper
cggggtggatctacccagcggcaatttggtggtcagagagccggcggaccgcgaacagc

SEQ ID NO: 8071 - DNA, 30 bp, Homo sapiens
  chr5:140345497-140345527
  hyper
ttttaggcttgctcccggaaagagggcagc

SEQ ID NO: 8072 - DNA, 30 bp, Homo sapiens
  chr5:140346719-140346749
  hyper
gctggcgcacaaccccgtggcggtgagcgc

SEQ ID NO: 8073 - DNA, 30 bp, Homo sapiens
  chr5:140514891-140514921
  hyper
cttcagggtgggcttcgttcttgtggaaat

SEQ ID NO: 8074 - DNA, 30 bp, Homo sapiens
  chr5:140593316-140593346
  hyper
ctgctcactaaagtccggcgatattaacgg

SEQ ID NO: 8075 - DNA, 42 bp, Homo sapiens; identical to SEQ ID NO: 2647
  chr5:140604459-140604501
  hyper

SEQ ID NO: 8076 - DNA, 15 bp, Homo sapiens
  chr5:140614383-140614398
  hyper
cgagcagctggaccg

SEQ ID NO: 8077 - DNA, 197 bp, Homo sapiens
  chr5:140777472-140777669
  hyper
cgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 8078 - DNA, 134 bp, Homo sapiens; identical to SEQ ID NO: 2648
  chr5:140797076-140797210
  hyper

SEQ ID NO: 8079 - DNA, 97 bp, Homo sapiens
  chr5:140797493-140797590
  hyper
ctttgttctaccccacgctgtgtgagccgatccgctactcgattccggaggagctggccaagggctcggtggtggggaacctcgctaaggatctagg

SEQ ID NO: 8080 - DNA, 73 bp, Homo sapiens
  chr5:140800570-140800643
  hyper
gggaatgggaagctgcgcgccattgagtccctccctcccccgcctctaccacacaaagcggaatgagatggat

SEQ ID NO: 8081 - DNA, 228 bp, Homo sapiens; identical to SEQ ID NO: 487
  chr5:140801034-140801262
  hyper

SEQ ID NO: 8082 - DNA, 861 bp, Homo sapiens; identical to SEQ ID NO: 488
  chr5:140855598-140856459
  hyper

SEQ ID NO: 8083 - DNA, 87 bp, Homo sapiens; identical to SEQ ID NO: 489
  chr5:140856546-140856633
  hyper

SEQ ID NO: 8084 - DNA, 347 bp, Homo sapiens; identical to SEQ ID NO: 2652
  chr5:141262718-141263065
  hyper

SEQ ID NO: 8085 - DNA, 36 bp, Homo sapiens
  chr5:141293999-141294035
  hyper
gggcgattctggggccgtctccgcaggcagttgagc

SEQ ID NO: 8086 - DNA, 25 bp, Homo sapiens
  chr5:141931330-141931355
  hyper
ctcacttctccttctcgcccttaat

SEQ ID NO: 8087 - DNA, 60 bp, Homo sapiens; identical to SEQ ID NO: 2654
  chr5:141931424-141931484
  hyper

SEQ ID NO: 8088 - DNA, 101 bp, Homo sapiens
  chr5:142781774-142781875
  hyper
aatgaatttccatgccgcttttttgacagctgccttcaaacccgaaaccaaaacaatatttcctaaaacgaaaacgctccctcaagcgacattatccccca

SEQ ID NO: 8089 - DNA, 136 bp, Homo sapiens
  chr5:143584941-143585077
  hyper
tgaaacaacagcatccgaactgcactgggaactgtggaaccacccagctccgccgccagagaagccggagccccgggccccccgccggcatctctgcgctgcgttggcctctggctcgcaccggctcccacctggc

SEQ ID NO: 8090 - DNA, 71 bp, Homo sapiens; identical to SEQ ID NO: 2655
  chr5:145713641-145713712
  hyper

SEQ ID NO: 8091 - DNA, 203 bp, Homo sapiens; identical to SEQ ID NO: 2656
  chr5:145716994-145717197
  hyper

SEQ ID NO: 8092 - DNA, 156 bp, Homo sapiens; identical to SEQ ID NO: 2657
  chr5:145717248-145717404
  hyper

SEQ ID NO: 8093 - DNA, 187 bp, Homo sapiens
  chr5:145717842-145718029
  hyper
agaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcggga

SEQ ID NO: 8094 - DNA, 93 bp, Homo sapiens
  chr5:145718853-145718946
  hyper
atgtttttttcatgtcgcccagaacaatcgccgctgtctgaacccctctccttgtctcccccgcgttctctcccggcgcgctctctctctcat

SEQ ID NO: 8095 - DNA, 232 bp, Homo sapiens
  chr5:145719364-145719596
  hyper
cacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggg

SEQ ID NO: 8096 - DNA, 42 bp, Homo sapiens; identical to SEQ ID NO: 2658
  chr5:145719895-145719937
  hyper

SEQ ID NO: 8097 - DNA, 280 bp, Homo sapiens; identical to SEQ ID NO: 2659
  chr5:145720018-145720298
  hyper

SEQ ID NO: 8098 - DNA, 92 bp, Homo sapiens; identical to SEQ ID NO: 490
  chr5:145722375-145722467
  hyper

SEQ ID NO: 8099 - DNA, 467 bp, Homo sapiens; identical to SEQ ID NO: 491
  chr5:145722560-145723027
  hyper

SEQ ID NO: 8100 - DNA, 161 bp, Homo sapiens
  chr5:145723309-145723470
  hyper
cctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctgg

SEQ ID NO: 8101 - DNA, 144 bp, Homo sapiens
  chr5:145724420-145724564
  hyper
tgagaagcttggccccggtcagcggctccaggagcccggaacctcctccctggcggaatcccgggcaccattcagccttttcgaaggctccagacttcgcgctgctcctcctcccgaggaggggcggggcgccagagggcaaag

SEQ ID NO: 8102 - DNA, 34 bp, Homo sapiens
  chr5:145724804-145724838
  hyper
atcacgttatcacaccgcccgttttatttctttc

SEQ ID NO: 8103 - DNA, 151 bp, Homo sapiens; identical to SEQ ID NO: 492
  chr5:145725693-145725844
  hyper

SEQ ID NO: 8104 - DNA, 24 bp, Homo sapiens
  chr5:146257460-146257484
  hyper
gcccggaggagtctccgccactac

SEQ ID NO: 8105 - DNA, 300 bp, Homo sapiens
  chr5:146257485-146257785
  hyper
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagag

SEQ ID NO: 8106 - DNA, 30 bp, Homo sapiens
  chr5:146258370-146258400
  hyper
gcgtcagcagccccacgactctttcccagc

SEQ ID NO: 8107 - DNA, 309 bp, Homo sapiens
  chr5:146888874-146889183
  hyper
tctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 8108 - DNA, 207 bp, Homo sapiens
  chr5:146889331-146889538
  hyper
cgggacctggtccgtggtgcccggcctggccaggtacacgggcagatcgtcttcgtgggagctgtcccagcccctccggcccgaggccatggttcaagcacgaaagcggcccgcgggtttttcttccccagaggcggaaagggcagccgccggcagcgtgcgccgagccacagtgactgtggcgggaggaggcgcctgagccttcgc

SEQ ID NO: 8109 - DNA, 36 bp, Homo sapiens
  chr5:146889539-146889575
  hyper
ccagaggcggcagtgctgctccgattcctgcttgtc

SEQ ID NO: 8110 - DNA, 160 bp, Homo sapiens
  chr5:148206272-148206432
  hyper
cacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggc

SEQ ID NO: 8111 - DNA, 299 bp, Homo sapiens
  chr5:148651823-148652122
  hyper
tccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggact

SEQ ID NO: 8112 - DNA, 71 bp, Homo sapiens
  chr5:149569700-149569771
  hyper
acaaggcattcgcagcgccctgcccgcgctccacgcccgcagccgccagacggcagcgcctgcgtccgtgc

SEQ ID NO: 8113 - DNA, 30 bp, Homo sapiens
  chr5:149682061-149682091
  hyper
gtccagtgtctggtccgggactggctgccg

SEQ ID NO: 8114 - DNA, 566 bp, Homo sapiens; identical to SEQ ID NO: 2663
  chr5:150051101-150051667
  hyper

SEQ ID NO: 8115 - DNA, 424 bp, Homo sapiens
  chr5:150399985-150400409
  hyper
tgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 8116 - DNA, 30 bp, Homo sapiens
  chr5:151066451-151066481
  hyper
gcagagcgcgctctccgggcagtctgaagg

SEQ ID NO: 8117 - DNA, 415 bp, Homo sapiens
  chr5:151304224-151304639
  hyper
ggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 8118 - DNA, 33 bp, Homo sapiens
  chr5:151304708-151304741
  hyper
cgttctcctgcctctgtgcgggtctgctgtcgc

SEQ ID NO: 8119 - DNA, 97 bp, Homo sapiens; identical to SEQ ID NO: 2664
  chr5:152870193-152870290
  hyper

SEQ ID NO: 8120 - DNA, 59 bp, Homo sapiens; identical to SEQ ID NO: 2665
  chr5:153852733-153852792
  hyper

SEQ ID NO: 8121 - DNA, 27 bp, Homo sapiens
  chr5:153853277-153853304
  hyper
gcccgcgtggcctctcggcccctgcta

SEQ ID NO: 8122 - DNA, 133 bp, Homo sapiens; identical to SEQ ID NO: 2667
  chr5:153853386-153853519
  hyper

SEQ ID NO: 8123 - DNA, 32 bp, Homo sapiens; identical to SEQ ID NO: 2668
  chr5:153855232-153855264
  hyper

SEQ ID NO: 8124 - DNA, 176 bp, Homo sapiens
  chr5:153855657-153855833
  hyper
cgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcacc

SEQ ID NO: 8125 - DNA, 62 bp, Homo sapiens
  chr5:153856334-153856396
  hyper
aagtgtcaccctaaccggagaggatcaagaaggccaagacgagactgcgctctccaaagcta

SEQ ID NO: 8126 - DNA, 36 bp, Homo sapiens
  chr5:153856624-153856660
  hyper
tttgaaaacaggaaccgagcccgggcacataaattc

SEQ ID NO: 8127 - DNA, 139 bp, Homo sapiens
  chr5:153856966-153857105
  hyper
cctgaggctgctcaccgctcctgcacccttggctggagcatgcaagccccaggactcaccagctcccttttccgcttgctctcacggccgccatccgccttcttgagttcagccttgaaggcctcgggatcgccagact

SEQ ID NO: 8128 - DNA, 30 bp, Homo sapiens
  chr5:153857851-153857881
  hyper
ccaatggcaggggggcggggataaggaaaa

SEQ ID NO: 8129 - DNA, 172 bp, Homo sapiens
  chr5:153858353-153858525
  hyper
caccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtag

SEQ ID NO: 8130 - DNA, 17 bp, Homo sapiens
  chr5:153858878-153858895
  hyper
agactgcacagcatccg

SEQ ID NO: 8131 - DNA, 18 bp, Homo sapiens
  chr5:153858916-153858934
  hyper
cgacgtccggcatctctc

SEQ ID NO: 8132 - DNA, 143 bp, Homo sapiens
  chr5:153862037-153862180
  hyper
taggacagctgtacccgggcaatgcgaaggtccctcaagcctggacgttctgcagtggtggggtctcgctcttgccctagcccctctcctaccctcacccctatccgcgccccccggactggcaggcctctggaagcccaggc

SEQ ID NO: 8133 - DNA, 246 bp, Homo sapiens
  chr5:153862218-153862464
  hyper
cgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaa

SEQ ID NO: 8134 - DNA, 23 bp, Homo sapiens
  chr5:153863394-153863417
  hyper
gagagatgtctgcttcgggacgc

SEQ ID NO: 8135 - DNA, 13 bp, Homo sapiens
  chr5:153863418-153863431
  hyper
ttcaacctaaaca

SEQ ID NO: 8136 - DNA, 53 bp, Homo sapiens
  chr5:153990970-153991023
  hyper
gacgggccacacacccgcgtgtacacacagtccgagaacgcacacacgtacac

SEQ ID NO: 8137 - DNA, 460 bp, Homo sapiens
  chr5:155107388-155107848
  hyper
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgc

SEQ ID NO: 8138 - DNA, 20 bp, Homo sapiens
  chr5:155108248-155108268
  hyper
cccggacgctcgagccggag

SEQ ID NO: 8139 - DNA, 116 bp, Homo sapiens
  chr5:155108733-155108849
  hyper
gagggagtccccttccgcttcctaaggagaaaaggggctccctagagcagatcgctgacttcctcaccaacgtgccatttggggcttttcagccgcccgcgcgttaagctagctcc

SEQ ID NO: 8140 - DNA, 240 bp, Homo sapiens
  chr5:155109207-155109447
  hyper
cgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtc

SEQ ID NO: 8141 - DNA, 259 bp, Homo sapiens
  chr5:156887194-156887453
  hyper
ccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggtgcgtacggcagggctggggaccaggcgggctccgcgcttcgcgccctcccctccttgccaccgctctccctcgcatcctctcctcc

SEQ ID NO: 8142 - DNA, 45 bp, Homo sapiens
  chr5:157001813-157001858
  hyper
cttagctggaaacatcgagtcagaccccttcgcttcacagaaggg

SEQ ID NO: 8143 - DNA, 315 bp, Homo sapiens
  chr5:157098344-157098659
  hyper
cacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgacc

SEQ ID NO: 8144 - DNA, 1 bp, Homo sapiens
  chr5:158478465-158478466
  hyper
g

SEQ ID NO: 8145 - DNA, 276 bp, Homo sapiens
  chr5:158478512-158478788
  hyper
cgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtg

SEQ ID NO: 8146 - DNA, 30 bp, Homo sapiens
  chr5:158524686-158524716
  hyper
atgtggagaagggtccgagggcggggctca

SEQ ID NO: 8147 - DNA, 375 bp, Homo sapiens; identical to SEQ ID NO: 493
  chr5:158527442-158527817
  hyper

SEQ ID NO: 8148 - DNA, 251 bp, Homo sapiens; identical to SEQ ID NO: 494
  chr5:158527818-158528069
  hyper

SEQ ID NO: 8149 - DNA, 88 bp, Homo sapiens
  chr5:158533565-158533653
  hyper
gggcccaagggcaggcgtgcagaccgctacgactttggctttagggagacgccttcggggcgcagggcccgcccgaagacgcgggtta

SEQ ID NO: 8150 - DNA, 28 bp, Homo sapiens
  chr5:159399072-159399100
  hyper
tcgcctgggcggctgcgcctacacctac

SEQ ID NO: 8151 - DNA, 262 bp, Homo sapiens
  chr5:160973528-160973790
  hyper
ccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggacc

SEQ ID NO: 8152 - DNA, 40 bp, Homo sapiens
  chr5:160974819-160974859
  hyper
gcgccccctccgctgcgcgcacccgcgcgcacacacgtgc

SEQ ID NO: 8153 - DNA, 235 bp, Homo sapiens
  chr5:160975112-160975347
  hyper
ttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 8154 - DNA, 100 bp, Homo sapiens
  chr5:160975348-160975448
  hyper
tccgaaggaaccggagtccacaccagcggctctccgggtactcctgagtttatcttggaactggggaagaggcgggaagagtagacgttcccgctacccc

SEQ ID NO: 8155 - DNA, 210 bp, Homo sapiens; identical to SEQ ID NO: 2672
  chr5:160975724-160975934
  hyper

SEQ ID NO: 8156 - DNA, 15 bp, Homo sapiens
  chr5:160975955-160975970
  hyper
cggaagtagctccac

SEQ ID NO: 8157 - DNA, 30 bp, Homo sapiens
  chr5:161274605-161274635
  hyper
ctctttcctaccatccgtcaccattcgtga

SEQ ID NO: 8158 - DNA, 30 bp, Homo sapiens
  chr5:162931253-162931283
  hyper
attatgcttgtttagcgctggggcagtcct

SEQ ID NO: 8159 - DNA, 79 bp, Homo sapiens
  chr5:162931522-162931601
  hyper
aaaaggtttaggagtcggggaaaggccctaggaaaatccagacagtggtcacgtttgtggacgacgtttagagcttgct

SEQ ID NO: 8160 - DNA, 37 bp, Homo sapiens
  chr5:166405784-166405821
  hyper
gcccctccctggctgcgtaccccgcagccacagcagc

SEQ ID NO: 8161 - DNA, 30 bp, Homo sapiens
  chr5:166406285-166406315
  hyper
tgcagaagcgagcaccgtttggggagtccg

SEQ ID NO: 8162 - DNA, 177 bp, Homo sapiens; identical to SEQ ID NO: 2674
  chr5:167956090-167956267
  hyper

SEQ ID NO: 8163 - DNA, 31 bp, Homo sapiens; identical to SEQ ID NO: 2675
  chr5:167956413-167956444
  hyper

SEQ ID NO: 8164 - DNA, 42 bp, Homo sapiens
  chr5:168727504-168727546
  hyper
aggggtactcacaggcgctcagcgttgcgggggatgccccga

SEQ ID NO: 8165 - DNA, 4 bp, Homo sapiens
  chr5:168727924-168727928
  hyper
gggc

SEQ ID NO: 8166 - DNA, 82 bp, Homo sapiens
  chr5:168727994-168728076
  hyper
cgcgggccgggttggggacctggggcgagcgcaatggggcgtggcgcccggggaggtccggcttggggctgggctggggagc

SEQ ID NO: 8167 - DNA, 35 bp, Homo sapiens
  chr5:168728077-168728112
  hyper
cggcggctgcggctggggcacggggcggccgggtg

SEQ ID NO: 8168 - DNA, 30 bp, Homo sapiens
  chr5:168728323-168728353
  hyper
ggaaggaaaggggctcggccagcagggccc

SEQ ID NO: 8169 - DNA, 63 bp, Homo sapiens
  chr5:169064022-169064085
  hyper
gcggtggtggtctggcgagccccaggtggggactggcctctgctccctcgcctggggaggaga

SEQ ID NO: 8170 - DNA, 235 bp, Homo sapiens; identical to SEQ ID NO: 2676
  chr5:169064295-169064530
  hyper

SEQ ID NO: 8171 - DNA, 274 bp, Homo sapiens; identical to SEQ ID NO: 2677
  chr5:169064531-169064805
  hyper

SEQ ID NO: 8172 - DNA, 38 bp, Homo sapiens
  chr5:169931409-169931447
  hyper
gaagcctcctagcctcgcctccacgcttgctgaatacc

SEQ ID NO: 8173 - DNA, 378 bp, Homo sapiens; identical to SEQ ID NO: 2678
  chr5:170108034-170108412
  hyper

SEQ ID NO: 8174 - DNA, 100 bp, Homo sapiens; identical to SEQ ID NO: 495
  chr5:170735131-170735231
  hyper

SEQ ID NO: 8175 - DNA, 1 bp, Homo sapiens
  chr5:170735730-170735731
  hyper
c

SEQ ID NO: 8176 - DNA, 116 bp, Homo sapiens; identical to SEQ ID NO: 496
  chr5:170736715-170736831
  hyper

SEQ ID NO: 8177 - DNA, 454 bp, Homo sapiens; identical to SEQ ID NO: 497
  chr5:170737281-170737735
  hyper

SEQ ID NO: 8178 - DNA, 69 bp, Homo sapiens; identical to SEQ ID NO: 498
  chr5:170737795-170737864
  hyper

SEQ ID NO: 8179 - DNA, 755 bp, Homo sapiens; identical to SEQ ID NO: 499
  chr5:170737935-170738690
  hyper

SEQ ID NO: 8180 - DNA, 1116 bp, Homo sapiens; identical to SEQ ID NO: 500
  chr5:170738823-170739939
  hyper

SEQ ID NO: 8181 - DNA, 23 bp, Homo sapiens
  chr5:170740455-170740478
  hyper
aaggcaaaacactttcggggccg

SEQ ID NO: 8182 - DNA, 99 bp, Homo sapiens; identical to SEQ ID NO: 2686
  chr5:170740574-170740673
  hyper

SEQ ID NO: 8183 - DNA, 125 bp, Homo sapiens; identical to SEQ ID NO: 2687
  chr5:170740674-170740799
  hyper

SEQ ID NO: 8184 - DNA, 741 bp, Homo sapiens; identical to SEQ ID NO: 2688
  chr5:170741487-170742228
  hyper

SEQ ID NO: 8185 - DNA, 152 bp, Homo sapiens; identical to SEQ ID NO: 501
  chr5:170742448-170742600
  hyper

SEQ ID NO: 8186 - DNA, 166 bp, Homo sapiens; identical to SEQ ID NO: 502
  chr5:170742672-170742838
  hyper

SEQ ID NO: 8187 - DNA, 342 bp, Homo sapiens; identical to SEQ ID NO: 503
  chr5:170743138-170743480
  hyper

SEQ ID NO: 8188 - DNA, 482 bp, Homo sapiens; identical to SEQ ID NO: 504
  chr5:170743646-170744128
  hyper

SEQ ID NO: 8189 - DNA, 66 bp, Homo sapiens
  chr5:170744496-170744562
  hyper
agttgaaacgaatgtcgttgctctgtcagacccgctgccaattaatgagttcgttattcaacccct

SEQ ID NO: 8190 - DNA, 30 bp, Homo sapiens
  chr5:170745324-170745354
  hyper
tgattatccagcatgcgaagctgccttgca

SEQ ID NO: 8191 - DNA, 253 bp, Homo sapiens
  chr5:172655851-172656104
  hyper
cgctgggcctgagctcggaatgcttcccggaggatgcgaggggcgggcgctgcggggaagacggtgctactcccgcgcgggaccgcgtgatgtttccgagtcagcggtgaaacctgcggcttccgcgcgtcctttaaaaatacaggtatttagatacacaccgtggcgtcgacttaaggtgaaatctaaacaaaatgaaaggacgggagctattctgatttggccgaacctgtgcctgcgggctgggaatgac

SEQ ID NO: 8192 - DNA, 63 bp, Homo sapiens
  chr5:172659592-172659655
  hyper
cagcgtggacactcccgagttgctctgcggaatcccggggctctgaaccgcattcaagtcccc

SEQ ID NO: 8193 - DNA, 171 bp, Homo sapiens; identical to SEQ ID NO: 505
  chr5:172659855-172660026
  hyper

SEQ ID NO: 8194 - DNA, 77 bp, Homo sapiens; identical to SEQ ID NO: 506
  chr5:172660141-172660218
  hyper

SEQ ID NO: 8195 - DNA, 82 bp, Homo sapiens; identical to SEQ ID NO: 2695
  chr5:172660919-172661001
  hyper

SEQ ID NO: 8196 - DNA, 20 bp, Homo sapiens
  chr5:172661126-172661146
  hyper
cgcgccggcaagttgtgctg

SEQ ID NO: 8197 - DNA, 359 bp, Homo sapiens; identical to SEQ ID NO: 2697
  chr5:172661471-172661830
  hyper

SEQ ID NO: 8198 - DNA, 157 bp, Homo sapiens
  chr5:172662041-172662198
  hyper
tttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggcca

SEQ ID NO: 8199 - DNA, 131 bp, Homo sapiens
  chr5:172664437-172664568
  hyper
tcgctgaaaagagctcggaacgagggtcctgggagcgctgttaagtgaatctgctggccaggcggctcgcgatgacagtttgaaagattagtgtgagcggacgcctgaaatattaccgtttaatgggggac

SEQ ID NO: 8200 - DNA, 170 bp, Homo sapiens
  chr5:172665691-172665861
  hyper
cgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttc

SEQ ID NO: 8201 - DNA, 149 bp, Homo sapiens; identical to SEQ ID NO: 2698
  chr5:172670933-172671082
  hyper

SEQ ID NO: 8202 - DNA, 87 bp, Homo sapiens; identical to SEQ ID NO: 507
  chr5:172671395-172671482
  hyper

SEQ ID NO: 8203 - DNA, 153 bp, Homo sapiens; identical to SEQ ID NO: 508
  chr5:172671639-172671792
  hyper

SEQ ID NO: 8204 - DNA, 92 bp, Homo sapiens
  chr5:172672801-172672893
  hyper
agactggggcccttccgctcggggtcaggcgcagcgccctcggcttgggccccgccgcccctttaggggtccgggagggtggagagaagggg

SEQ ID NO: 8205 - DNA, 363 bp, Homo sapiens
  chr5:172754563-172754926
  hyper
aaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcc

SEQ ID NO: 8206 - DNA, 93 bp, Homo sapiens
  chr5:172755470-172755563
  hyper
cttgaatgaaggagtcgagcaggtgttgtcccggcggctggaccaatccgagaccccggcccttttgacaacacggccgggaggcggggcctg

SEQ ID NO: 8207 - DNA, 69 bp, Homo sapiens
  chr5:172755594-172755663
  hyper
cgctgggagcgccggacaaagttgccgacctggcggcggccacgcgtttgcgtgcgtgtgtatgagtgt

SEQ ID NO: 8208 - DNA, 719 bp, Homo sapiens
  chr5:172756377-172757096
  hyper
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagt

SEQ ID NO: 8209 - DNA, 156 bp, Homo sapiens; identical to SEQ ID NO: 2701
  chr5:174115433-174115589
  hyper

SEQ ID NO: 8210 - DNA, 55 bp, Homo sapiens
  chr5:174119987-174120042
  hyper
taattttgaaagggtcgctgtaagacactgactaatgacacgtgacctttggatt

SEQ ID NO: 8211 - DNA, 154 bp, Homo sapiens
  chr5:174147428-174147582
  hyper
ctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggc

SEQ ID NO: 8212 - DNA, 279 bp, Homo sapiens; identical to SEQ ID NO: 2702
  chr5:174159299-174159578
  hyper

SEQ ID NO: 8213 - DNA, 37 bp, Homo sapiens
  chr5:174162509-174162546
  hyper
cgcaggaagggggcgcgtcacccggtttccccataga

SEQ ID NO: 8214 - DNA, 30 bp, Homo sapiens
  chr5:174162799-174162829
  hyper
cccggcccgctccaccggcacggaagatcg

SEQ ID NO: 8215 - DNA, 120 bp, Homo sapiens
  chr5:174178667-174178787
  hyper
agggagaagaggggccgcggccgcgcgccccgccatcagctgcgcgcacagagggagagttcactccggggacaagggcggcgcgaccggcccggggctcttgggcggccgcgtttcccc

SEQ ID NO: 8216 - DNA, 1140 bp, Homo sapiens; identical to SEQ ID NO: 2703
  chr5:174870738-174871878
  hyper

SEQ ID NO: 8217 - DNA, 241 bp, Homo sapiens; identical to SEQ ID NO: 2704
  chr5:175085074-175085315
  hyper

SEQ ID NO: 8218 - DNA, 79 bp, Homo sapiens; identical to SEQ ID NO: 2705
  chr5:175085524-175085603
  hyper

SEQ ID NO: 8219 - DNA, 30 bp, Homo sapiens; identical to SEQ ID NO: 2706
  chr5:175223920-175223950
  hyper

SEQ ID NO: 8220 - DNA, 92 bp, Homo sapiens
  chr5:175224643-175224735
  hyper
agggggctgagaagccgcggggaagcctcacgaacgggacagctccaggctccctctctccctcactccccgggttccgcccccacctccag

SEQ ID NO: 8221 - DNA, 35 bp, Homo sapiens
  chr5:175298647-175298682
  hyper
accacctcgtggagtcgggccggagccctgcagtg

SEQ ID NO: 8222 - DNA, 40 bp, Homo sapiens
  chr5:175298910-175298950
  hyper
aaggacagctccttgcgaggggccgcgagcaggcagctag

SEQ ID NO: 8223 - DNA, 44 bp, Homo sapiens
  chr5:175299304-175299348
  hyper
ctttccgggaggagccgccgcttggacagcgcacgcccgccgcc

SEQ ID NO: 8224 - DNA, 161 bp, Homo sapiens
  chr5:175299980-175300141
  hyper
gaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 8225 - DNA, 29 bp, Homo sapiens
  chr5:175300142-175300171
  hyper
cagggatagaccaaggcttcccgcagaat

SEQ ID NO: 8226 - DNA, 196 bp, Homo sapiens
  chr5:175300216-175300412
  hyper
cggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatcta

SEQ ID NO: 8227 - DNA, 42 bp, Homo sapiens
  chr5:175488184-175488226
  hyper
agccaggagaacccgcgagcccagcggcgcctgcacctgcgg

SEQ ID NO: 8228 - DNA, 180 bp, Homo sapiens
  chr5:175560567-175560747
  hyper
cgccagcttgcaagtcgtgcatttacctcttttggctgcacagagggcagggaagcctcgcgggtatgcaagatcgggaatggctgggggtgcgaccaaggggacttggagaaccgccccgcctccccaggttcccctggtagagcgcaccaccccccacccccgcgagttttcagaggc

SEQ ID NO: 8229 - DNA, 30 bp, Homo sapiens
  chr5:175621379-175621409
  hyper
tctccaagctgaggccgggtggcctgcgac

SEQ ID NO: 8230 - DNA, 101 bp, Homo sapiens
  chr5:175792208-175792309
  hyper
cggttttcccttctgcgtggtatcattgtaaggggtaacggagaaaagccgtgagctaacccctggtggatgctagcaagcaccgccgtctcccgtcctcc

SEQ ID NO: 8231 - DNA, 68 bp, Homo sapiens
  chr5:175792864-175792932
  hyper
cgagggcttggcagccgcagcgcacaggccccgcgcgggtgggcggtcagagcccgggaaccgaggaa

SEQ ID NO: 8232 - DNA, 34 bp, Homo sapiens
  chr5:175792997-175793031
  hyper
cgggtgttccagcgggggccggagtttggagggc

SEQ ID NO: 8233 - DNA, 204 bp, Homo sapiens
  chr5:176024005-176024209
  hyper
gctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtca

SEQ ID NO: 8234 - DNA, 30 bp, Homo sapiens
  chr5:176038550-176038580
  hyper
gcttcctcacatttccggtcctgaaaattg

SEQ ID NO: 8235 - DNA, 272 bp, Homo sapiens; identical to SEQ ID NO: 2707
  chr5:176046306-176046578
  hyper

SEQ ID NO: 8236 - DNA, 458 bp, Homo sapiens; identical to SEQ ID NO: 2708
  chr5:176056505-176056963
  hyper

SEQ ID NO: 8237 - DNA, 103 bp, Homo sapiens
  chr5:176057411-176057514
  hyper
ggtcctgagcaggagcgcagcagtgcccgggtctcgggtgcgtagccagccaccgctcgttcctcgcgccctgcgagctcgcgcgctccggctccggctccgg

SEQ ID NO: 8238 - DNA, 125 bp, Homo sapiens; identical to SEQ ID NO: 2709
  chr5:176107360-176107485
  hyper

SEQ ID NO: 8239 - DNA, 69 bp, Homo sapiens; identical to SEQ ID NO: 2710
  chr5:176107517-176107586
  hyper

SEQ ID NO: 8240 - DNA, 42 bp, Homo sapiens
  chr5:176236773-176236815
  hyper
tcggggctcaaacaccgcgcgcccagtcgggtgtgctgcgcc

SEQ ID NO: 8241 - DNA, 95 bp, Homo sapiens
  chr5:176264805-176264900
  hyper
gatagcggtcctggacgtggcacgctttcagcaccgtggacagccccaggcgctccacagaggctgtccctctgcggactcggcttcctaacctc

SEQ ID NO: 8242 - DNA, 95 bp, Homo sapiens; identical to SEQ ID NO: 2711
  chr5:177411327-177411422
  hyper

SEQ ID NO: 8243 - DNA, 15 bp, Homo sapiens
  chr5:177411507-177411522
  hyper
cgcggagatgggcca

SEQ ID NO: 8244 - DNA, 452 bp, Homo sapiens
  chr5:177411766-177412218
  hyper
agattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcggtggctcac

SEQ ID NO: 8245 - DNA, 30 bp, Homo sapiens
  chr5:178004344-178004374
  hyper
ctgtgccacctcatccgcctctttaaagac

SEQ ID NO: 8246 - DNA, 303 bp, Homo sapiens; identical to SEQ ID NO: 509
  chr5:178016681-178016984
  hyper

SEQ ID NO: 8247 - DNA, 52 bp, Homo sapiens; identical to SEQ ID NO: 510
  chr5:178017519-178017571
  hyper

SEQ ID NO: 8248 - DNA, 111 bp, Homo sapiens; identical to SEQ ID NO: 511
  chr5:178017572-178017683
  hyper

SEQ ID NO: 8249 - DNA, 197 bp, Homo sapiens
  chr5:178450910-178451107
  hyper
ggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgct

SEQ ID NO: 8250 - DNA, 46 bp, Homo sapiens
  chr5:178487258-178487304
  hyper
gcctttgagagctctcgttggcggaggcggttcctctcccggagtt

SEQ ID NO: 8251 - DNA, 83 bp, Homo sapiens
  chr5:178487341-178487424
  hyper
cggcgtggggccggaggcatgccgggagtggtagttctcccgcggttggcggggtttcggggacagctcgcggcctttcgggg

SEQ ID NO: 8252 - DNA, 30 bp, Homo sapiens
  chr5:178487700-178487730
  hyper
atgccagccttttgtcgttgttcattctgc

SEQ ID NO: 8253 - DNA, 81 bp, Homo sapiens
  chr5:178594307-178594388
  hyper
ggcccgggccggggacgcacccggcgcccagactccgcggccgcacccgggctcccggggccccagcggccccaagacagc

SEQ ID NO: 8254 - DNA, 100 bp, Homo sapiens; identical to SEQ ID NO: 2716
  chr5:178770805-178770905
  hyper

SEQ ID NO: 8255 - DNA, 433 bp, Homo sapiens; identical to SEQ ID NO: 2717
  chr5:178771198-178771631
  hyper

SEQ ID NO: 8256 - DNA, 58 bp, Homo sapiens; identical to SEQ ID NO: 2718
  chr5:178771723-178771781
  hyper

SEQ ID NO: 8257 - DNA, 78 bp, Homo sapiens; identical to SEQ ID NO: 2719
  chr5:178771782-178771860
  hyper

SEQ ID NO: 8258 - DNA, 3 bp, Homo sapiens
  chr5:178771967-178771970
  hyper
cgc

SEQ ID NO: 8259 - DNA, 546 bp, Homo sapiens; identical to SEQ ID NO: 2721
  chr5:178772184-178772730
  hyper

SEQ ID NO: 8260 - DNA, 58 bp, Homo sapiens; identical to SEQ ID NO: 2722
  chr5:178772778-178772836
  hyper

SEQ ID NO: 8261 - DNA, 240 bp, Homo sapiens; identical to SEQ ID NO: 2723
  chr5:178957706-178957946
  hyper

SEQ ID NO: 8262 - DNA, 22 bp, Homo sapiens
  chr5:179244320-179244342
  hyper
gggcgttcgtcctccatccctc

SEQ ID NO: 8263 - DNA, 135 bp, Homo sapiens
  chr5:179779648-179779783
  hyper
acgttcctttggggtcgcgaggaggacgcgcaggccctgcctgaggcactgacgcagcgggggcgaccgggcgggctgcggggacggcggggcggggtcgcctctcctctcctcggtgggcgcggcgggctgagt

SEQ ID NO: 8264 - DNA, 173 bp, Homo sapiens
  chr5:179779840-179780013
  hyper
cgactgggagacgtggaggagagcgacctcggtcggcatggggtggggacccctctgttacggggtccaggccggaccggaccaggtccctcccctccgtggggaccgggcctcggtccccctcactgtgtccgagaccaggagtcgggttgggcatcccccacccacacctc

SEQ ID NO: 8265 - DNA, 227 bp, Homo sapiens
  chr5:179780035-179780262
  hyper
cgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgccc

SEQ ID NO: 8266 - DNA, 699 bp, Homo sapiens; identical to SEQ ID NO: 2724
  chr5:179780528-179781227
  hyper

SEQ ID NO: 8267 - DNA, 30 bp, Homo sapiens
  chr5:179867518-179867548
  hyper
caaggcagcccagatcgggagggagggtcc

SEQ ID NO: 8268 - DNA, 179 bp, Homo sapiens
  chr5:180017145-180017324
  hyper
atggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagc

SEQ ID NO: 8269 - DNA, 153 bp, Homo sapiens; identical to SEQ ID NO: 2725
  chr5:180017536-180017689
  hyper

SEQ ID NO: 8270 - DNA, 442 bp, Homo sapiens; identical to SEQ ID NO: 2726
  chr5:180017690-180018132
  hyper

SEQ ID NO: 8271 - DNA, 126 bp, Homo sapiens; identical to SEQ ID NO: 2727
  chr5:180018484-180018610
  hyper

SEQ ID NO: 8272 - DNA, 44 bp, Homo sapiens; identical to SEQ ID NO: 512
  chr5:180075814-180075858
  hyper

SEQ ID NO: 8273 - DNA, 405 bp, Homo sapiens; identical to SEQ ID NO: 513
  chr5:180076053-180076458
  hyper

SEQ ID NO: 8274 - DNA, 314 bp, Homo sapiens; identical to SEQ ID NO: 514
  chr5:180076532-180076846
  hyper

SEQ ID NO: 8275 - DNA, 30 bp, Homo sapiens
  chr5:180100685-180100715
  hyper
cagaggggaccactgcgcctcctgcctgag

SEQ ID NO: 8276 - DNA, 153 bp, Homo sapiens; identical to SEQ ID NO: 2731
  chr5:180101015-180101168
  hyper

SEQ ID NO: 8277 - DNA, 39 bp, Homo sapiens
  chr5:180527793-180527832
  hyper
cgactggaaatccgggtgcacctccgccccccggggcgc

SEQ ID NO: 8278 - DNA, 135 bp, Homo sapiens; identical to SEQ ID NO: 2732
  chr5:180531170-180531305
  hyper

SEQ ID NO: 8279 - DNA, 210 bp, Homo sapiens; identical to SEQ ID NO: 2733
  chr5:180600858-180601068
  hyper

SEQ ID NO: 8280 - DNA, 90 bp, Homo sapiens; identical to SEQ ID NO: 2734
  chr5:180601128-180601218
  hyper

SEQ ID NO: 8281 - DNA, 534 bp, Homo sapiens; identical to SEQ ID NO: 515
  chr6:391209-391743
  hyper

SEQ ID NO: 8282 - DNA, 20 bp, Homo sapiens
  chr6:391744-391764
  hyper
cactctcagtttcaccgctc

SEQ ID NO: 8283 - DNA, 135 bp, Homo sapiens; identical to SEQ ID NO: 517
  chr6:391765-391900
  hyper

SEQ ID NO: 8284 - DNA, 25 bp, Homo sapiens
  chr6:392409-392434
  hyper
gctctcccgggcctgctccggggtc

SEQ ID NO: 8285 - DNA, 372 bp, Homo sapiens; identical to SEQ ID NO: 519
  chr6:392587-392959
  hyper

SEQ ID NO: 8286 - DNA, 115 bp, Homo sapiens; identical to SEQ ID NO: 520
  chr6:393124-393239
  hyper

SEQ ID NO: 8287 - DNA, 233 bp, Homo sapiens; identical to SEQ ID NO: 521
  chr6:393240-393473
  hyper

SEQ ID NO: 8288 - DNA, 45 bp, Homo sapiens
  chr6:1314017-1314062
  hyper
agccactccgaggcccggcggccggcggcgcgcacctgtactgcc

SEQ ID NO: 8289 - DNA, 277 bp, Homo sapiens; identical to SEQ ID NO: 2742
  chr6:1378199-1378476
  hyper

SEQ ID NO: 8290 - DNA, 123 bp, Homo sapiens
  chr6:1379267-1379390
  hyper
cgaaaccaccccggggaaagccgtaggggcgcgccggcccacgcgggaccgagttcagaggactctgcaccgtcagtttcagggccgacgtttatagagcgcttcccacgtgccgcacgcggt

SEQ ID NO: 8291 - DNA, 363 bp, Homo sapiens
  chr6:1383078-1383441
  hyper
gccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgcccc

SEQ ID NO: 8292 - DNA, 21 bp, Homo sapiens
  chr6:1383859-1383880
  hyper
ggggcccggggcctttggcca

SEQ ID NO: 8293 - DNA, 53 bp, Homo sapiens; identical to SEQ ID NO: 522
  chr6:1384127-1384180
  hyper

SEQ ID NO: 8294 - DNA, 19 bp, Homo sapiens
  chr6:1384625-1384644
  hyper
cgagcgttgccacagccgg

SEQ ID NO: 8295 - DNA, 67 bp, Homo sapiens
  chr6:1385157-1385224
  hyper
gcaatttgggaagtgcggaaatggggtgaggccggtcttcgcttgagggtctcgtagattggacccc

SEQ ID NO: 8296 - DNA, 81 bp, Homo sapiens
  chr6:1389124-1389205
  hyper
ctctgctcaaagttccgaaaacgtccacgatcgccagcggcccgcaaccctgcggcggcccccagtcgccctaacaattgt

SEQ ID NO: 8297 - DNA, 63 bp, Homo sapiens
  chr6:1389953-1390016
  hyper
cggggagggatgcgccgggcgttgcctcccgcccgccgccgccgccgccgccagaagccccag

SEQ ID NO: 8298 - DNA, 77 bp, Homo sapiens
  chr6:1390484-1390561
  hyper
gccctactcgtacatcgcgctcatcgtcatggccatccagagctcgcccagcaagcgcctgacgctcagcgagatct

SEQ ID NO: 8299 - DNA, 451 bp, Homo sapiens
  chr6:1390955-1391406
  hyper
cgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctcc

SEQ ID NO: 8300 - DNA, 30 bp, Homo sapiens
  chr6:1605320-1605350
  hyper
cccggcgcctgggtccgctgcggcgccggg

SEQ ID NO: 8301 - DNA, 347 bp, Homo sapiens
  chr6:1611408-1611755
  hyper
cgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagct

SEQ ID NO: 8302 - DNA, 261 bp, Homo sapiens; identical to SEQ ID NO: 524
  chr6:1625257-1625518
  hyper

SEQ ID NO: 8303 - DNA, 440 bp, Homo sapiens
  chr6:2903077-2903517
  hyper
aagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccc

SEQ ID NO: 8304 - DNA, 48 bp, Homo sapiens
  chr6:3229011-3229059
  hyper
tttcttatcttccatcgcggcgacctggaggtccgaggcttcgtgctg

SEQ ID NO: 8305 - DNA, 39 bp, Homo sapiens
  chr6:3231729-3231768
  hyper
agctggaaccagcagcgaaaaccccgagcccacgaacgc

SEQ ID NO: 8306 - DNA, 41 bp, Homo sapiens
  chr6:4775411-4775452
  hyper
acatggaggaactggcgagggcttcccgatgcagggcctgg

SEQ ID NO: 8307 - DNA, 179 bp, Homo sapiens
  chr6:5086150-5086329
  hyper
cgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 8308 - DNA, 30 bp, Homo sapiens
  chr6:5851769-5851799
  hyper
ggaggcctggtcacccgcaggccctgccat

SEQ ID NO: 8309 - DNA, 638 bp, Homo sapiens
  chr6:5996066-5996704
  hyper
tcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcc

SEQ ID NO: 8310 - DNA, 87 bp, Homo sapiens
  chr6:5996959-5997046
  hyper
tatttatacgcagaccgaaaataaccattgaaacgaaaccaacaaaatgcaactattttccaaaaccccgagcgtttgctggtgggt

SEQ ID NO: 8311 - DNA, 36 bp, Homo sapiens
  chr6:5997581-5997617
  hyper
caggcctgcagtccccggacccgggtcgcctctgcc

SEQ ID NO: 8312 - DNA, 260 bp, Homo sapiens; identical to SEQ ID NO: 525
  chr6:6003269-6003529
  hyper

SEQ ID NO: 8313 - DNA, 395 bp, Homo sapiens; identical to SEQ ID NO: 526
  chr6:6004349-6004744
  hyper

SEQ ID NO: 8314 - DNA, 329 bp, Homo sapiens; identical to SEQ ID NO: 527
  chr6:6004836-6005165
  hyper

SEQ ID NO: 8315 - DNA, 192 bp, Homo sapiens; identical to SEQ ID NO: 528
  chr6:6006691-6006883
  hyper

SEQ ID NO: 8316 - DNA, 352 bp, Homo sapiens; identical to SEQ ID NO: 2751
  chr6:6007318-6007670
  hyper

SEQ ID NO: 8317 - DNA, 102 bp, Homo sapiens; identical to SEQ ID NO: 2752
  chr6:6007671-6007773
  hyper

SEQ ID NO: 8318 - DNA, 274 bp, Homo sapiens; identical to SEQ ID NO: 2753
  chr6:6007833-6008107
  hyper

SEQ ID NO: 8319 - DNA, 30 bp, Homo sapiens
  chr6:6009468-6009498
  hyper
agggcctcaatgaagcgggtgaacccacgc

SEQ ID NO: 8320 - DNA, 95 bp, Homo sapiens
  chr6:6546546-6546641
  hyper
caccgcaaccgcagccgcagccgcggaggggaggccgtgcacccgcccgccgggagagccgcgcgcctgagccgggcgcacgtgggaagtgggcc

SEQ ID NO: 8321 - DNA, 296 bp, Homo sapiens
  chr6:6546926-6547222
  hyper
ctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 8322 - DNA, 123 bp, Homo sapiens
  chr6:7726824-7726947
  hyper
gaggcccagagtgaccgcgccgcgactcgcaggagccagggcgcaggctgcagtgcagcccggactcagacgcacctggcctggaccgcgcgcctctagagacctgcgcgaggctgtgaggct

SEQ ID NO: 8323 - DNA, 447 bp, Homo sapiens
  chr6:7727322-7727769
  hyper
ggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 8324 - DNA, 752 bp, Homo sapiens
  chr6:7728086-7728838
  hyper
cggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgctt

SEQ ID NO: 8325 - DNA, 86 bp, Homo sapiens; identical to SEQ ID NO: 529
  chr6:10381507-10381593
  hyper

SEQ ID NO: 8326 - DNA, 138 bp, Homo sapiens; identical to SEQ ID NO: 530
  chr6:10381831-10381969
  hyper

SEQ ID NO: 8327 - DNA, 184 bp, Homo sapiens; identical to SEQ ID NO: 2756
  chr6:10382722-10382906
  hyper

SEQ ID NO: 8328 - DNA, 142 bp, Homo sapiens
  chr6:10383858-10384000
  hyper
cctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagc

SEQ ID NO: 8329 - DNA, 30 bp, Homo sapiens
  chr6:10384438-10384468
  hyper
tgcccctgcgggtcccgattacagatgaat

SEQ ID NO: 8330 - DNA, 20 bp, Homo sapiens
  chr6:10384955-10384975
  hyper
gagggggagccgtggcgggc

SEQ ID NO: 8331 - DNA, 354 bp, Homo sapiens
  chr6:10385499-10385853
  hyper
gggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacacca

SEQ ID NO: 8332 - DNA, 63 bp, Homo sapiens
  chr6:10386210-10386273
  hyper
agctggctgtcttcccgcctggggtgggctctcaattcaactggacctcgggtcctgtcaagg

SEQ ID NO: 8333 - DNA, 1050 bp, Homo sapiens; identical to SEQ ID NO: 531
  chr6:10390023-10391073
  hyper

SEQ ID NO: 8334 - DNA, 59 bp, Homo sapiens
  chr6:10391337-10391396
  hyper
ggccgctgcccaggccgtccacatttccctccctggctgtccttcgagcccctaccagt

SEQ ID NO: 8335 - DNA, 30 bp, Homo sapiens
  chr6:10411311-10411341
  hyper
aaagggcagaagaaacgcctgactttaggt

SEQ ID NO: 8336 - DNA, 44 bp, Homo sapiens
  chr6:10411992-10412036
  hyper
cggctcggatccatccgaacttgaaccaccgattcgcgcggcgc

SEQ ID NO: 8337 - DNA, 102 bp, Homo sapiens
  chr6:10415113-10415215
  hyper
agggagggtcaagctcggagcctgtgaccgcacggatgatcgagccggcgtcgcgcttacctcgcagtcctcgtacttgatattatccgtcaatttccaaag

SEQ ID NO: 8338 - DNA, 154 bp, Homo sapiens
  chr6:10415559-10415713
  hyper
aatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgcccca

SEQ ID NO: 8339 - DNA, 30 bp, Homo sapiens
  chr6:10416118-10416148
  hyper
atcccttaattgcagcgtgtaaaataaaag

SEQ ID NO: 8340 - DNA, 65 bp, Homo sapiens; identical to SEQ ID NO: 2758
  chr6:10417158-10417223
  hyper

SEQ ID NO: 8341 - DNA, 103 bp, Homo sapiens; identical to SEQ ID NO: 532
  chr6:10417427-10417530
  hyper

SEQ ID NO: 8342 - DNA, 363 bp, Homo sapiens; identical to SEQ ID NO: 533
  chr6:10419077-10419440
  hyper

SEQ ID NO: 8343 - DNA, 56 bp, Homo sapiens; identical to SEQ ID NO: 534
  chr6:10419476-10419532
  hyper

SEQ ID NO: 8344 - DNA, 74 bp, Homo sapiens
  chr6:10419828-10419902
  hyper
acctgccgacgcatgcgcgctggcccaggaattcactccgccagctgcagtcccagcgccgcacagagctgacc

SEQ ID NO: 8345 - DNA, 38 bp, Homo sapiens
  chr6:10420118-10420156
  hyper
cgaactgggggagtctccactcccgggtgggggtcggg

SEQ ID NO: 8346 - DNA, 96 bp, Homo sapiens; identical to SEQ ID NO: 535
  chr6:10421356-10421452
  hyper

SEQ ID NO: 8347 - DNA, 568 bp, Homo sapiens; identical to SEQ ID NO: 536
  chr6:10421548-10422116
  hyper

SEQ ID NO: 8348 - DNA, 306 bp, Homo sapiens; identical to SEQ ID NO: 2764
  chr6:10422355-10422661
  hyper

SEQ ID NO: 8349 - DNA, 141 bp, Homo sapiens
  chr6:10423946-10424087
  hyper
ccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 8350 - DNA, 161 bp, Homo sapiens; identical to SEQ ID NO: 2765
  chr6:10425629-10425790
  hyper

SEQ ID NO: 8351 - DNA, 54 bp, Homo sapiens; identical to SEQ ID NO: 2766
  chr6:10425838-10425892
  hyper

SEQ ID NO: 8352 - DNA, 393 bp, Homo sapiens; identical to SEQ ID NO: 2767
  chr6:10426185-10426578
  hyper

SEQ ID NO: 8353 - DNA, 210 bp, Homo sapiens; identical to SEQ ID NO: 2768
  chr6:10881854-10882064
  hyper

SEQ ID NO: 8354 - DNA, 35 bp, Homo sapiens
  chr6:10886917-10886952
  hyper
attacaggcgtgagccaccgcgcctggccgcccct

SEQ ID NO: 8355 - DNA, 16 bp, Homo sapiens
  chr6:10887169-10887185
  hyper
gtaaacttcagggggc

SEQ ID NO: 8356 - DNA, 486 bp, Homo sapiens; identical to SEQ ID NO: 2770
  chr6:10887186-10887672
  hyper

SEQ ID NO: 8357 - DNA, 228 bp, Homo sapiens
  chr6:11043878-11044106
  hyper
cccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 8358 - DNA, 262 bp, Homo sapiens
  chr6:11044107-11044369
  hyper
ccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgcc

SEQ ID NO: 8359 - DNA, 42 bp, Homo sapiens
  chr6:12749899-12749941
  hyper
ctcccacattaatggcggcatcctcggaggatgatatagacc

SEQ ID NO: 8360 - DNA, 18 bp, Homo sapiens
  chr6:12750364-12750382
  hyper
gggcgaggttggctggcg

SEQ ID NO: 8361 - DNA, 101 bp, Homo sapiens
  chr6:13013581-13013682
  hyper
gctacgggttggacccgccggagagggtaatttgctgtggccctggaggggagcttgcacccgaggtttcccagtgcagcgctttccgtgtgaaacatttt

SEQ ID NO: 8362 - DNA, 36 bp, Homo sapiens
  chr6:13013897-13013933
  hyper
gcctaccccctcctccggcttcgggatccggattgg

SEQ ID NO: 8363 - DNA, 147 bp, Homo sapiens
  chr6:13925376-13925523
  hyper
gggggcggcaaacttcgggccgagcggcgccggggcccgcgcgcggagtctccctccgggcaccacgggggccgccgtcctggcaccaacttgaggggctgtgcggcggagggcggctgcggagcgcccgcgcgggctgcacctgct

SEQ ID NO: 8364 - DNA, 30 bp, Homo sapiens
  chr6:18122697-18122727
  hyper
ccgcaggacaggttgcgcgggcgccgctgc

SEQ ID NO: 8365 - DNA, 347 bp, Homo sapiens
  chr6:18277573-18277920
  hyper
agagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagcc

SEQ ID NO: 8366 - DNA, 102 bp, Homo sapiens; identical to SEQ ID NO: 2771
  chr6:19691895-19691997
  hyper

SEQ ID NO: 8367 - DNA, 44 bp, Homo sapiens; identical to SEQ ID NO: 2772
  chr6:19692142-19692186
  hyper

SEQ ID NO: 8368 - DNA, 32 bp, Homo sapiens
  chr6:21665034-21665066
  hyper
ctggtgcgagtgaagcgcggggcgggggaggc

SEQ ID NO: 8369 - DNA, 113 bp, Homo sapiens
  chr6:21665754-21665867
  hyper
ggcggcctgggaccccgagtcagatctttggggtgagcacgaggacgtggtgtagggaagaggacgagtgagcagcgcctggctgtagggtcagagggcgcctggtcatcctg

SEQ ID NO: 8370 - DNA, 32 bp, Homo sapiens
  chr6:24126437-24126469
  hyper
cagctgtcaatcaggcgcgggctgagctctac

SEQ ID NO: 8371 - DNA, 101 bp, Homo sapiens
  chr6:24494728-24494829
  hyper
ctacaactgaagaagcgtgatcacggccttggcatttagggcaggcaccagcgcatctatggaccgcgcacaaattccggggatgccgaatttgggggatg

SEQ ID NO: 8372 - DNA, 30 bp, Homo sapiens
  chr6:26020909-26020939
  hyper
aaactacctttccagcgcctggtgcgcgag

SEQ ID NO: 8373 - DNA, 51 bp, Homo sapiens
  chr6:26087615-26087666
  hyper
gccccccaaaagaagcggagatttaacggggacgtgcggccagagctgggg

SEQ ID NO: 8374 - DNA, 66 bp, Homo sapiens
  chr6:26088186-26088252
  hyper
acccacagcaggatccgcacggggtttccacctcagaacgaatgcgttgggcggtgggggcgcgaa

SEQ ID NO: 8375 - DNA, 30 bp, Homo sapiens
  chr6:26172122-26172152
  hyper
catcccatcaaccctcgccaaaaacgccgg

SEQ ID NO: 8376 - DNA, 80 bp, Homo sapiens; identical to SEQ ID NO: 2773
  chr6:26184021-26184101
  hyper

SEQ ID NO: 8377 - DNA, 163 bp, Homo sapiens; identical to SEQ ID NO: 2774
  chr6:26188740-26188903
  hyper

SEQ ID NO: 8378 - DNA, 117 bp, Homo sapiens
  chr6:26189276-26189393
  hyper
cctttccgcccttaccgcggccagacatcttgaaaccacagctgttaaatctgtaacgcaatacgtctggcagagccacgcagcacttttataatagcatgacggacctgtttgaaa

SEQ ID NO: 8379 - DNA, 38 bp, Homo sapiens
  chr6:26199182-26199220
  hyper
acttgtttagctcctcgtcgttgcggatggccagctgc

SEQ ID NO: 8380 - DNA, 25 bp, Homo sapiens
  chr6:26200129-26200154
  hyper
gcaccaaggccgtcaccaagtacac

SEQ ID NO: 8381 - DNA, 71 bp, Homo sapiens
  chr6:26205142-26205213
  hyper
ctgaagagacagggacgcactctttacggcttcggcggctaatgctaccgcttaaacgactcagcatctcg

SEQ ID NO: 8382 - DNA, 30 bp, Homo sapiens
  chr6:26205682-26205712
  hyper
acttaacctaacgaccgagtttaggtgtgt

SEQ ID NO: 8383 - DNA, 449 bp, Homo sapiens
  chr6:26234025-26234474
  hyper
accttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttca

SEQ ID NO: 8384 - DNA, 30 bp, Homo sapiens
  chr6:26234702-26234732
  hyper
tttgatgcttttcttcggggtagcggcgcc

SEQ ID NO: 8385 - DNA, 122 bp, Homo sapiens
  chr6:26234942-26235064
  hyper
atcgtagccagcagccgcaagcgctttcttaagcgcggccagagaaacgccgctgcgctccttagaagctgccactgccttggtgataagctcagatactgggggtccggatgctttgcgtt

SEQ ID NO: 8386 - DNA, 436 bp, Homo sapiens; identical to SEQ ID NO: 2775
  chr6:26240682-26241118
  hyper

SEQ ID NO: 8387 - DNA, 41 bp, Homo sapiens; identical to SEQ ID NO: 2776
  chr6:26250098-26250139
  hyper

SEQ ID NO: 8388 - DNA, 486 bp, Homo sapiens; identical to SEQ ID NO: 2777
  chr6:26250199-26250685
  hyper

SEQ ID NO: 8389 - DNA, 154 bp, Homo sapiens; identical to SEQ ID NO: 2778
  chr6:26250686-26250840
  hyper

SEQ ID NO: 8390 - DNA, 128 bp, Homo sapiens; identical to SEQ ID NO: 2779
  chr6:26251054-26251182
  hyper

SEQ ID NO: 8391 - DNA, 325 bp, Homo sapiens; identical to SEQ ID NO: 2780
  chr6:26251641-26251966
  hyper

SEQ ID NO: 8392 - DNA, 208 bp, Homo sapiens; identical to SEQ ID NO: 2781
  chr6:26271371-26271579
  hyper

SEQ ID NO: 8393 - DNA, 197 bp, Homo sapiens
  chr6:26272512-26272709
  hyper
tctcgtcgtggatggcgagctgcaggcgtcggggggtgacgcgggtcttcttgtctcgggccgcgttgcccgccaactccaggatcttggcggtcaggtactccagcaccgcctccaggtacaccggcgcaccggcccggacccgcttggcgtagttgcccttgcggaggaggcggtgcactcggcccacagaaaac

SEQ ID NO: 8394 - DNA, 159 bp, Homo sapiens
  chr6:26273111-26273270
  hyper
tcatttgcatatacacgaggtaaataatgagggcgtttgggctcaccagcattttcctgtggtcatttgacggtatcacttcggctgcgaacatgcctgaaccagctaagtcagctcccgccccgaagaagggctccaagaaggcggtgaccaaggcac

SEQ ID NO: 8395 - DNA, 180 bp, Homo sapiens
  chr6:26273570-26273750
  hyper
ccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccggg

SEQ ID NO: 8396 - DNA, 101 bp, Homo sapiens
  chr6:26322530-26322631
  hyper
cctccttacttaccccgcttctcctttggctggagctcggcgagcgagaggcggcgctgggctggcgttggagagcgacggcaggacggctgcggctacga

SEQ ID NO: 8397 - DNA, 157 bp, Homo sapiens; identical to SEQ ID NO: 537
  chr6:26327825-26327982
  hyper

SEQ ID NO: 8398 - DNA, 85 bp, Homo sapiens; identical to SEQ ID NO: 2783
  chr6:26328331-26328416
  hyper

SEQ ID NO: 8399 - DNA, 30 bp, Homo sapiens
  chr6:26331781-26331811
  hyper
tcatgaaaataatttcggtactggtgaaga

SEQ ID NO: 8400 - DNA, 36 bp, Homo sapiens
  chr6:26332172-26332208
  hyper
cacaaccagtgtttccgttaacgaattcacgcgggg

SEQ ID NO: 8401 - DNA, 240 bp, Homo sapiens; identical to SEQ ID NO: 538
  chr6:26501949-26502189
  hyper

SEQ ID NO: 8402 - DNA, 187 bp, Homo sapiens
  chr6:26550872-26551059
  hyper
taggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccgg

SEQ ID NO: 8403 - DNA, 277 bp, Homo sapiens; identical to SEQ ID NO: 2785
  chr6:26577158-26577435
  hyper

SEQ ID NO: 8404 - DNA, 166 bp, Homo sapiens
  chr6:26577722-26577888
  hyper
tggctcttggtttctcgatgccattcttatttccggctactgatcgtcaaatgcagtttttattcccacttcccctctccatccccgacccgagctgacgttcgaccagcaaaccacagccaacgcccgcaacacagttcagttaagaaggcgcgtgggaggtgtg

SEQ ID NO: 8405 - DNA, 102 bp, Homo sapiens; identical to SEQ ID NO: 2786
  chr6:27064667-27064769
  hyper

SEQ ID NO: 8406 - DNA, 233 bp, Homo sapiens; identical to SEQ ID NO: 2787
  chr6:27064770-27065003
  hyper

SEQ ID NO: 8407 - DNA, 264 bp, Homo sapiens; identical to SEQ ID NO: 2788
  chr6:27065004-27065268
  hyper

SEQ ID NO: 8408 - DNA, 275 bp, Homo sapiens
  chr6:27100686-27100961
  hyper
tgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaa

SEQ ID NO: 8409 - DNA, 97 bp, Homo sapiens
  chr6:27173954-27174051
  hyper
ttacccacatcccccccgcccccatccccaccccgccgcttaactaagagggctttgcctgaagggcctggactgccttatacgtctgtttagaaaa

SEQ ID NO: 8410 - DNA, 79 bp, Homo sapiens; identical to SEQ ID NO: 2789
  chr6:27205332-27205411
  hyper

SEQ ID NO: 8411 - DNA, 46 bp, Homo sapiens
  chr6:27205940-27205986
  hyper
aaggaagaaaatctccggcagctatgcctcgcgggttcataaggac

SEQ ID NO: 8412 - DNA, 15 bp, Homo sapiens
  chr6:27228172-27228187
  hyper
gaagagcccacctgc

SEQ ID NO: 8413 - DNA, 170 bp, Homo sapiens; identical to SEQ ID NO: 540
  chr6:27228289-27228459
  hyper

SEQ ID NO: 8414 - DNA, 16 bp, Homo sapiens
  chr6:27243064-27243080
  hyper
acgctgggtgcagctc

SEQ ID NO: 8415 - DNA, 103 bp, Homo sapiens; identical to SEQ ID NO: 2792
  chr6:27247636-27247739
  hyper

SEQ ID NO: 8416 - DNA, 153 bp, Homo sapiens; identical to SEQ ID NO: 2793
  chr6:27256079-27256232
  hyper

SEQ ID NO: 8417 - DNA, 725 bp, Homo sapiens; identical to SEQ ID NO: 541
  chr6:27279795-27280520
  hyper

SEQ ID NO: 8418 - DNA, 498 bp, Homo sapiens; identical to SEQ ID NO: 2795
  chr6:27463133-27463631
  hyper

SEQ ID NO: 8419 - DNA, 33 bp, Homo sapiens
  chr6:27471362-27471395
  hyper
tgtcctgacagaccccgtcgttttggcttaggc

SEQ ID NO: 8420 - DNA, 123 bp, Homo sapiens; identical to SEQ ID NO: 542
  chr6:27512761-27512884
  hyper

SEQ ID NO: 8421 - DNA, 151 bp, Homo sapiens; identical to SEQ ID NO: 543
  chr6:27512994-27513145
  hyper

SEQ ID NO: 8422 - DNA, 138 bp, Homo sapiens; identical to SEQ ID NO: 2798
  chr6:27513349-27513487
  hyper

SEQ ID NO: 8423 - DNA, 385 bp, Homo sapiens; identical to SEQ ID NO: 2799
  chr6:27533992-27534377
  hyper

SEQ ID NO: 8424 - DNA, 61 bp, Homo sapiens
  chr6:27559892-27559953
  hyper
agagtgggaccccttcggtagtgaataatcccgcagctcattattgcgaacagcagccctt

SEQ ID NO: 8425 - DNA, 30 bp, Homo sapiens
  chr6:27572883-27572913
  hyper
gactgatcagttgaacggctaaggaaaaga

SEQ ID NO: 8426 - DNA, 267 bp, Homo sapiens
  chr6:27573326-27573593
  hyper
tcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaa

SEQ ID NO: 8427 - DNA, 188 bp, Homo sapiens
  chr6:27598672-27598860
  hyper
agagatgctggactgcgaatgcaggcgcgctgcaggcgaggctgggagggccgccaggagcgctgcgggtatcgggagacacgcagagggaggggcaggcggcgggctccgcttcttcgcgtcctggctctgaaagcaaccacaggccagcggggcggtgctaggtgaagctacgaagaagccaaata

SEQ ID NO: 8428 - DNA, 81 bp, Homo sapiens
  chr6:27599260-27599341
  hyper
ccgaggttgtgagttcgagcctcacctggagcatgttttcttccaattgcgatttcagacatttcacgataatgcattttt

SEQ ID NO: 8429 - DNA, 189 bp, Homo sapiens
  chr6:27635245-27635434
  hyper
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttga

SEQ ID NO: 8430 - DNA, 30 bp, Homo sapiens
  chr6:27636385-27636415
  hyper
gcgtggtgctaataacgccaaggtcgcggg

SEQ ID NO: 8431 - DNA, 39 bp, Homo sapiens
  chr6:27647697-27647736
  hyper
acctgtcttaaagttcgcgatttttaccaaaataggcca

SEQ ID NO: 8432 - DNA, 34 bp, Homo sapiens
  chr6:27648814-27648848
  hyper
aaccgcaaactggttcgtgcgtaagaaggaatag

SEQ ID NO: 8433 - DNA, 239 bp, Homo sapiens
  chr6:27661759-27661998
  hyper
taaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacct

SEQ ID NO: 8434 - DNA, 225 bp, Homo sapiens
  chr6:27774914-27775139
  hyper
tggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtaca

SEQ ID NO: 8435 - DNA, 120 bp, Homo sapiens
  chr6:27782468-27782588
  hyper
gtcttggccttggcgcgagctttgcctccctgcttaccacgcccagacatggcaaaaggtctattacctttacggtcaagaaagactgaaatgaaattggaaaaacgtacattttatagc

SEQ ID NO: 8436 - DNA, 64 bp, Homo sapiens
  chr6:27834196-27834260
  hyper
cgaacacattagtgacgccgaagtagctggtgcctaaatggcttaaacgcggaaaaaccacata

SEQ ID NO: 8437 - DNA, 51 bp, Homo sapiens
  chr6:27834803-27834854
  hyper
tttgacgccagccgccgcgggcttcttcgccttcttcggagtcttcttcac

SEQ ID NO: 8438 - DNA, 19 bp, Homo sapiens
  chr6:27835078-27835097
  hyper
ccacgtcgtagccaccggc

SEQ ID NO: 8439 - DNA, 884 bp, Homo sapiens; identical to SEQ ID NO: 2801
  chr6:27839689-27840573
  hyper

SEQ ID NO: 8440 - DNA, 49 bp, Homo sapiens
  chr6:27858327-27858376
  hyper
ggttttgaaatcctgcgcgatttctcgcaccaggcgctgaaatggcagt

SEQ ID NO: 8441 - DNA, 292 bp, Homo sapiens
  chr6:28175300-28175592
  hyper
gcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagcc

SEQ ID NO: 8442 - DNA, 446 bp, Homo sapiens; identical to SEQ ID NO: 2802
  chr6:28175836-28176282
  hyper

SEQ ID NO: 8443 - DNA, 225 bp, Homo sapiens; identical to SEQ ID NO: 544
  chr6:28367054-28367279
  hyper

SEQ ID NO: 8444 - DNA, 67 bp, Homo sapiens; identical to SEQ ID NO: 545
  chr6:28367280-28367347
  hyper

SEQ ID NO: 8445 - DNA, 81 bp, Homo sapiens; identical to SEQ ID NO: 546
  chr6:28367490-28367571
  hyper

SEQ ID NO: 8446 - DNA, 243 bp, Homo sapiens; identical to SEQ ID NO: 547
  chr6:28367572-28367815
  hyper

SEQ ID NO: 8447 - DNA, 16 bp, Homo sapiens
  chr6:28411014-28411030
  hyper
agcccttccaggctgc

SEQ ID NO: 8448 - DNA, 57 bp, Homo sapiens; identical to SEQ ID NO: 549
  chr6:28411031-28411088
  hyper

SEQ ID NO: 8449 - DNA, 241 bp, Homo sapiens; identical to SEQ ID NO: 550
  chr6:28411151-28411392
  hyper

SEQ ID NO: 8450 - DNA, 15 bp, Homo sapiens
  chr6:28414977-28414992
  hyper
tcaaaccctttcagg

SEQ ID NO: 8451 - DNA, 28 bp, Homo sapiens
  chr6:28415091-28415119
  hyper
cgttcccctttatcggctctattgccag

SEQ ID NO: 8452 - DNA, 30 bp, Homo sapiens
  chr6:28457825-28457855
  hyper
gggacccgcccagaacgctttcgtggggtt

SEQ ID NO: 8453 - DNA, 76 bp, Homo sapiens
  chr6:34433517-34433593
  hyper
cagggagcaacatcccgggctccgagcgcgccagctgggagggctggggaggagggcgcaccggagggctcccggc

SEQ ID NO: 8454 - DNA, 71 bp, Homo sapiens
  chr6:35181353-35181424
  hyper
tgtttggtctggagccgagcggagcttgcattgatccattgattgcgcgcggtctgcgcctgacctccctg

SEQ ID NO: 8455 - DNA, 187 bp, Homo sapiens; identical to SEQ ID NO: 551
  chr6:36252984-36253171
  hyper

SEQ ID NO: 8456 - DNA, 53 bp, Homo sapiens
  chr6:36806954-36807007
  hyper
actctgggaagggggcgcgcggaggtttaggatcgaagcggcaggggccgcgg

SEQ ID NO: 8457 - DNA, 127 bp, Homo sapiens
  chr6:36808176-36808303
  hyper
tctctgctgagtgtgcgccctactcgggggcgggtctcagttcagaaacagaccctacatctccttctggggaggtgtgtgggggcgaccccagtgccaggagggactacctcggtttcccagtggc

SEQ ID NO: 8458 - DNA, 294 bp, Homo sapiens
  chr6:37664165-37664459
  hyper
gccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 8459 - DNA, 56 bp, Homo sapiens
  chr6:37673293-37673349
  hyper
aaagggggtggggggcgggaaatctggcgtggacttggaggcgttcagcacacccg

SEQ ID NO: 8460 - DNA, 80 bp, Homo sapiens
  chr6:39016550-39016630
  hyper
cccgggatcagtctccgcacgcggttccgcaggtggcagcgatggcccagtcctgaactccccgccatggccggcgcccc

SEQ ID NO: 8461 - DNA, 251 bp, Homo sapiens
  chr6:39016678-39016929
  hyper
cggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttc

SEQ ID NO: 8462 - DNA, 218 bp, Homo sapiens
  chr6:39281088-39281306
  hyper
gcctttctgggcagccgcgcggcggcggcgcgcccagtccttgtgtccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggc

SEQ ID NO: 8463 - DNA, 358 bp, Homo sapiens
  chr6:39281616-39281974
  hyper
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtc

SEQ ID NO: 8464 - DNA, 30 bp, Homo sapiens
  chr6:39902189-39902219
  hyper
cgggagcacactggccgggcactcgccccc

SEQ ID NO: 8465 - DNA, 148 bp, Homo sapiens
  chr6:40554589-40554737
  hyper
agttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcg

SEQ ID NO: 8466 - DNA, 164 bp, Homo sapiens
  chr6:41337045-41337209
  hyper
gccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcc

SEQ ID NO: 8467 - DNA, 296 bp, Homo sapiens
  chr6:41339263-41339559
  hyper
ccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 8468 - DNA, 363 bp, Homo sapiens
  chr6:41339601-41339964
  hyper
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacc

SEQ ID NO: 8469 - DNA, 125 bp, Homo sapiens
  chr6:41340913-41341038
  hyper
acagcggggtacggccggagtccgccccagcccccgcgccggagctgcgggtggcagggtcgggccgcggtaacccgagccgccgcgccggctccccgcgcgctgccctccgcctgccccttcgc

SEQ ID NO: 8470 - DNA, 48 bp, Homo sapiens
  chr6:41341501-41341549
  hyper
cctggacagaccaggcgagcctcgctcctggtgcgggagctagttttc

SEQ ID NO: 8471 - DNA, 245 bp, Homo sapiens
  chr6:41342779-41343024
  hyper
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttc

SEQ ID NO: 8472 - DNA, 32 bp, Homo sapiens
  chr6:41343650-41343682
  hyper
tctttgaaaatggaacgcgactttcagacaag

SEQ ID NO: 8473 - DNA, 15 bp, Homo sapiens
  chr6:41605937-41605952
  hyper
cagagagcagggagt

SEQ ID NO: 8474 - DNA, 320 bp, Homo sapiens; identical to SEQ ID NO: 2812
  chr6:41606037-41606357
  hyper

SEQ ID NO: 8475 - DNA, 42 bp, Homo sapiens; identical to SEQ ID NO: 2813
  chr6:41606527-41606569
  hyper

SEQ ID NO: 8476 - DNA, 46 bp, Homo sapiens
  chr6:42879523-42879569
  hyper
tagggacacctgccccgctccctccccctcccgggggggaacccac

SEQ ID NO: 8477 - DNA, 53 bp, Homo sapiens
  chr6:42879621-42879674
  hyper
cggcctccaggcagccctgggaaagcaagggccgggagcgcagccctggaggc

SEQ ID NO: 8478 - DNA, 15 bp, Homo sapiens
  chr6:43612884-43612899
  hyper
ggcagggcctcagcc

SEQ ID NO: 8479 - DNA, 78 bp, Homo sapiens
  chr6:43613052-43613130
  hyper
cgctctataggtgaggaggcccccgggacgggctccccagagggtggctacctggaggcagggcggggtgggcgggtc

SEQ ID NO: 8480 - DNA, 57 bp, Homo sapiens
  chr6:45387985-45388042
  hyper
aagggctccagagtccgcgactggcaccaggcccccatcttccgtgcccctcatgct

SEQ ID NO: 8481 - DNA, 30 bp, Homo sapiens
  chr6:45388359-45388389
  hyper
actgatgatttttttcgcaaacacgttttc

SEQ ID NO: 8482 - DNA, 369 bp, Homo sapiens
  chr6:45391172-45391541
  hyper
ctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcaggg

SEQ ID NO: 8483 - DNA, 931 bp, Homo sapiens
  chr6:46702594-46703525
  hyper
gagagaaaaaaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacgcgacccaagcgctccaaacccgactgcttctcgccgacagcactgcgagcctccgaccagccgctgtccccctggctgcgggccgagcagctctggcaggcggcgggcgggtgggctgcgcgcgggctgtgtcctgggtccgcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgctcaccagctcctttccgcagacctgatgccgatcagatttactccctgctgaattcaccccccagtcaggccggttttccttgtttcaccgtgttctctgaatacactgaattactccgagcatctatagttggcaatgccctgcgcattttccgcactccgatacactttacac

SEQ ID NO: 8484 - DNA, 348 bp, Homo sapiens
  chr6:50674363-50674711
  hyper
gttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactg

SEQ ID NO: 8485 - DNA, 460 bp, Homo sapiens; identical to SEQ ID NO: 2814
  chr6:50681604-50682064
  hyper

SEQ ID NO: 8486 - DNA, 20 bp, Homo sapiens
  chr6:50682319-50682339
  hyper
tgattttgagcagcccgggc

SEQ ID NO: 8487 - DNA, 236 bp, Homo sapiens; identical to SEQ ID NO: 2816
  chr6:50682448-50682684
  hyper

SEQ ID NO: 8488 - DNA, 230 bp, Homo sapiens; identical to SEQ ID NO: 2817
  chr6:50682711-50682941
  hyper

SEQ ID NO: 8489 - DNA, 64 bp, Homo sapiens; identical to SEQ ID NO: 2818
  chr6:50682991-50683055
  hyper

SEQ ID NO: 8490 - DNA, 30 bp, Homo sapiens
  chr6:50689980-50690010
  hyper
actttaccctgtgctcgcgtatcgatagct

SEQ ID NO: 8491 - DNA, 49 bp, Homo sapiens
  chr6:50690631-50690680
  hyper
gaagcttaaacactgcggtagcctctgggccacgcgaagagggagcgga

SEQ ID NO: 8492 - DNA, 304 bp, Homo sapiens; identical to SEQ ID NO: 552
  chr6:50691909-50692213
  hyper

SEQ ID NO: 8493 - DNA, 213 bp, Homo sapiens; identical to SEQ ID NO: 553
  chr6:50692299-50692512
  hyper

SEQ ID NO: 8494 - DNA, 561 bp, Homo sapiens
  chr6:50787316-50787877
  hyper
tgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 8495 - DNA, 61 bp, Homo sapiens
  chr6:50788317-50788378
  hyper
tggtggggattgtttcggttcggcctccttttctttccttaacaggcgggataatggtaaa

SEQ ID NO: 8496 - DNA, 318 bp, Homo sapiens; identical to SEQ ID NO: 554
  chr6:50791177-50791495
  hyper

SEQ ID NO: 8497 - DNA, 36 bp, Homo sapiens; identical to SEQ ID NO: 555
  chr6:50791550-50791586
  hyper

SEQ ID NO: 8498 - DNA, 30 bp, Homo sapiens
  chr6:50793374-50793404
  hyper
gtgaacggagcacctcggggccaagttgtt

SEQ ID NO: 8499 - DNA, 77 bp, Homo sapiens
  chr6:50794608-50794685
  hyper
tgagttgtttttctgcgcttccgcatgcagtcctaattaaatctttacgatcctccctgtgacgattaagcgccagc

SEQ ID NO: 8500 - DNA, 58 bp, Homo sapiens
  chr6:50803834-50803892
  hyper
catgtctgtcaacaccggcgaggtgttttgctccgtcccaggccgtttgtctctgctc

SEQ ID NO: 8501 - DNA, 216 bp, Homo sapiens; identical to SEQ ID NO: 556
  chr6:50804152-50804368
  hyper

SEQ ID NO: 8502 - DNA, 59 bp, Homo sapiens
  chr6:50808681-50808740
  hyper
cgcggcccaaacagccgcgctcatttatttagtgttggaggacgcggtttgtcccgttg

SEQ ID NO: 8503 - DNA, 87 bp, Homo sapiens; identical to SEQ ID NO: 557
  chr6:50810627-50810714
  hyper

SEQ ID NO: 8504 - DNA, 30 bp, Homo sapiens
  chr6:50811838-50811868
  hyper
cagagcaggttctggcggctgaggaaaatc

SEQ ID NO: 8505 - DNA, 490 bp, Homo sapiens; identical to SEQ ID NO: 558
  chr6:50813325-50813815
  hyper

SEQ ID NO: 8506 - DNA, 332 bp, Homo sapiens
  chr6:50818676-50819008
  hyper
gactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 8507 - DNA, 134 bp, Homo sapiens
  chr6:55443894-55444028
  hyper
gaggaggatgaggggcgggcaccgcgctgggaaactgcgccagctcgggagcgcgcccctccggtgcactggctgtgaggaccagagctgttctgcgcactgcggcggcgccgagagggcggggagtggggcgt

SEQ ID NO: 8508 - DNA, 213 bp, Homo sapiens
  chr6:56112173-56112386
  hyper
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccct

SEQ ID NO: 8509 - DNA, 55 bp, Homo sapiens
  chr6:56716640-56716695
  hyper
acatgaagatttgcacggaagaagtgtgtggcctgtggtccggccaccagctcac

SEQ ID NO: 8510 - DNA, 527 bp, Homo sapiens; identical to SEQ ID NO: 559
  chr6:56818720-56819247
  hyper

SEQ ID NO: 8511 - DNA, 59 bp, Homo sapiens
  chr6:56820782-56820841
  hyper
cagtgtgcctttctgcggacggccacggccacctggccaggaagcggctgctgcagcag

SEQ ID NO: 8512 - DNA, 83 bp, Homo sapiens; identical to SEQ ID NO: 2827
  chr6:58147428-58147511
  hyper

SEQ ID NO: 8513 - DNA, 214 bp, Homo sapiens; identical to SEQ ID NO: 2828
  chr6:58147762-58147976
  hyper

SEQ ID NO: 8514 - DNA, 420 bp, Homo sapiens; identical to SEQ ID NO: 560
  chr6:62995455-62995875
  hyper

SEQ ID NO: 8515 - DNA, 53 bp, Homo sapiens; identical to SEQ ID NO: 561
  chr6:62996077-62996130
  hyper

SEQ ID NO: 8516 - DNA, 83 bp, Homo sapiens; identical to SEQ ID NO: 562
  chr6:62996131-62996214
  hyper

SEQ ID NO: 8517 - DNA, 181 bp, Homo sapiens; identical to SEQ ID NO: 563
  chr6:62996215-62996396
  hyper

SEQ ID NO: 8518 - DNA, 30 bp, Homo sapiens
  chr6:69345066-69345096
  hyper
gcgcggcacccgggacgcgcgcgcacacga

SEQ ID NO: 8519 - DNA, 30 bp, Homo sapiens
  chr6:69345341-69345371
  hyper
gaggagggaggaaagcggaaagaggaaaaa

SEQ ID NO: 8520 - DNA, 174 bp, Homo sapiens
  chr6:69942843-69943017
  hyper
ggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactg

SEQ ID NO: 8521 - DNA, 26 bp, Homo sapiens
  chr6:70992136-70992162
  hyper
cgtcccggagccgccagcaccgctag

SEQ ID NO: 8522 - DNA, 58 bp, Homo sapiens; identical to SEQ ID NO: 2833
  chr6:70992440-70992498
  hyper

SEQ ID NO: 8523 - DNA, 207 bp, Homo sapiens
  chr6:70992853-70993060
  hyper
cagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctcc

SEQ ID NO: 8524 - DNA, 190 bp, Homo sapiens
  chr6:71666491-71666681
  hyper
ccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcc

SEQ ID NO: 8525 - DNA, 280 bp, Homo sapiens
  chr6:71666698-71666978
  hyper
cgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggt

SEQ ID NO: 8526 - DNA, 30 bp, Homo sapiens
  chr6:72129768-72129798
  hyper
ccgcagcccgaggtgcgggagccctcggac

SEQ ID NO: 8527 - DNA, 22 bp, Homo sapiens
  chr6:72130023-72130045
  hyper
gggggctgggcgagccgggaga

SEQ ID NO: 8528 - DNA, 31 bp, Homo sapiens
  chr6:72130190-72130221
  hyper
cgccgccgccgcccaccgcgttctttgtgtg

SEQ ID NO: 8529 - DNA, 75 bp, Homo sapiens
  chr6:72596060-72596135
  hyper
tgtaggggtagcggccggggcacgcgtggctcggacccggggagtgggcgggtgggtgcccgtgggcggagcggc

SEQ ID NO: 8530 - DNA, 87 bp, Homo sapiens
  chr6:72596136-72596223
  hyper
ccgggactgagtggctggcagctatgtctgcgagagcagcggcatcaccctggatggaagcctctgagactccgcctaactgacacc

SEQ ID NO: 8531 - DNA, 32 bp, Homo sapiens
  chr6:72596950-72596982
  hyper
cactcccctagtcctcgcggctgagtgtgggg

SEQ ID NO: 8532 - DNA, 150 bp, Homo sapiens; identical to SEQ ID NO: 564
  chr6:73329801-73329951
  hyper

SEQ ID NO: 8533 - DNA, 30 bp, Homo sapiens
  chr6:73330633-73330663
  hyper
tgcggccagtggcaccgtggcctctctctc

SEQ ID NO: 8534 - DNA, 164 bp, Homo sapiens; identical to SEQ ID NO: 565
  chr6:73330950-73331114
  hyper

SEQ ID NO: 8535 - DNA, 123 bp, Homo sapiens; identical to SEQ ID NO: 566
  chr6:73331115-73331238
  hyper

SEQ ID NO: 8536 - DNA, 390 bp, Homo sapiens; identical to SEQ ID NO: 567
  chr6:73331239-73331629
  hyper

SEQ ID NO: 8537 - DNA, 37 bp, Homo sapiens
  chr6:73331883-73331920
  hyper
ctggcggccccctcgcggtgcccgtggtgatgccatg

SEQ ID NO: 8538 - DNA, 329 bp, Homo sapiens; identical to SEQ ID NO: 2838
  chr6:73332136-73332465
  hyper

SEQ ID NO: 8539 - DNA, 302 bp, Homo sapiens
  chr6:73332675-73332977
  hyper
caaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctccc

SEQ ID NO: 8540 - DNA, 681 bp, Homo sapiens
  chr6:74019413-74020094
  hyper
cagcctctggaaggccgacagcatttcgcgtttctggcctgggaaagtaagggtgcgctaaggcacgagtagtacagctcctcccgccaccgcagagcccgccggcgggaagagaccagacaccgacggagaagcgaagttcaggacgcgaaggaaagggccacttcgggtcggggtcaacccagactggaccaatgcacagtctaggtggattaacgcgccaccgcgagaagtgggcacgggaccacatgcggctggcaagacgtcccagggctcaagctccaggctcggtcaccaaacaacggtgataacatccacaacgccacgtaaaccatctttgggccttgatcgttttccaataaccgactgaactgagggcgtgaccaaacgacaagaaccggaggagaggacccggagaacggagcagcatcccgccgcccgcctccaggaaagcccgaggcactgtagcaggagggtctgggctccgcgccttaattacaccgccctggacccgcctcttccgccgctcgctcctctgaccggcacccgaaggtgctgtcccgcccacggactcgctcacactccgtttcttcgatcctttagacgactttttaccgttcagggatgctctccgttaccgcctctgccatttggttgccctccctgcggtccaagggcctg

SEQ ID NO: 8541 - DNA, 63 bp, Homo sapiens
  chr6:74405916-74405979
  hyper
agcccaggcagacgccgtcgagatgcagggcccaccgctcctgaccgccgcccacctcctctg

SEQ ID NO: 8542 - DNA, 30 bp, Homo sapiens
  chr6:75914569-75914599
  hyper
caaaggagagcttagcgtttatttcctttc

SEQ ID NO: 8543 - DNA, 72 bp, Homo sapiens
  chr6:75915049-75915121
  hyper
ccctccaaagaattccgcaccgtgcgtcaccaaaataccttcccagcgcccccgccgcacgcctgccctccc

SEQ ID NO: 8544 - DNA, 36 bp, Homo sapiens
  chr6:75915170-75915206
  hyper
cggcgcgccctccattgaaatcgacagcatctacag

SEQ ID NO: 8545 - DNA, 90 bp, Homo sapiens
  chr6:75915711-75915801
  hyper
tgagcctgcagctgccggcgcgcggacgcgtctggggcggttcgccttagccaagtggaaagagactccgcgccgcgggctacttaatag

SEQ ID NO: 8546 - DNA, 153 bp, Homo sapiens
  chr6:75916306-75916459
  hyper
ctaactgtctgtacacgcggcgcgccttctgtctttttcaatctccaagcgcgattggaaacccggacagccgcccgcgcggggctcagtgatgggatggctttcccagtcctttctcactcccctggtgcttcaggacggaactgggaggct

SEQ ID NO: 8547 - DNA, 174 bp, Homo sapiens
  chr6:78172322-78172496
  hyper
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgt

SEQ ID NO: 8548 - DNA, 95 bp, Homo sapiens
  chr6:78173771-78173866
  hyper
cggacgagctgccccgcggagacggagccataaaaggggggacacgggggctggagttgcggctgctcgggccgcgccgccgccaccgccaccct

SEQ ID NO: 8549 - DNA, 30 bp, Homo sapiens
  chr6:78176103-78176133
  hyper
aatttgttccccacacggtttttggcttta

SEQ ID NO: 8550 - DNA, 33 bp, Homo sapiens
  chr6:78176496-78176529
  hyper
ctctgcagtccccagcggcgctagaaggaacct

SEQ ID NO: 8551 - DNA, 30 bp, Homo sapiens
  chr6:78176804-78176834
  hyper
gcggtgagctggctgcggaggaaccaaaga

SEQ ID NO: 8552 - DNA, 42 bp, Homo sapiens
  chr6:79620753-79620795
  hyper
tttattgccaagggtcgggatggccttcgtgtcctctgcagc

SEQ ID NO: 8553 - DNA, 560 bp, Homo sapiens; identical to SEQ ID NO: 2839
  chr6:80656673-80657233
  hyper

SEQ ID NO: 8554 - DNA, 70 bp, Homo sapiens
  chr6:80657499-80657569
  hyper
ctcattagccttccccgcccctgtcccgggcatcggcccctgcggaggagttcaccgcctccccacgggt

SEQ ID NO: 8555 - DNA, 272 bp, Homo sapiens; identical to SEQ ID NO: 568
  chr6:84417429-84417701
  hyper

SEQ ID NO: 8556 - DNA, 52 bp, Homo sapiens
  chr6:84418260-84418312
  hyper
cgccgccggctccaaagcctcgccgaggcccatcgcccgggccccttccccc

SEQ ID NO: 8557 - DNA, 116 bp, Homo sapiens
  chr6:84418570-84418686
  hyper
ctgagcggcgccgcccgccgcaggatgagcggagcccgggccgccgagggaagccgcgccggtggatgtgtgcgaccgcgcgtagccccggtgcccccgggcgcaaagtctccagc

SEQ ID NO: 8558 - DNA, 100 bp, Homo sapiens; identical to SEQ ID NO: 2841
  chr6:84419102-84419202
  hyper

SEQ ID NO: 8559 - DNA, 126 bp, Homo sapiens; identical to SEQ ID NO: 2842
  chr6:84419203-84419329
  hyper

SEQ ID NO: 8560 - DNA, 61 bp, Homo sapiens; identical to SEQ ID NO: 2843
  chr6:84419330-84419391
  hyper

SEQ ID NO: 8561 - DNA, 110 bp, Homo sapiens; identical to SEQ ID NO: 2844
  chr6:84562820-84562930
  hyper

SEQ ID NO: 8562 - DNA, 354 bp, Homo sapiens; identical to SEQ ID NO: 2845
  chr6:84562931-84563285
  hyper

SEQ ID NO: 8563 - DNA, 437 bp, Homo sapiens; identical to SEQ ID NO: 2846
  chr6:84563416-84563853
  hyper

SEQ ID NO: 8564 - DNA, 30 bp, Homo sapiens
  chr6:85471966-85471996
  hyper
tataaccgccctgaacgcagaacatcaacc

SEQ ID NO: 8565 - DNA, 866 bp, Homo sapiens; identical to SEQ ID NO: 569
  chr6:85472401-85473267
  hyper

SEQ ID NO: 8566 - DNA, 694 bp, Homo sapiens; identical to SEQ ID NO: 570
  chr6:85473508-85474202
  hyper

SEQ ID NO: 8567 - DNA, 139 bp, Homo sapiens
  chr6:85474485-85474624
  hyper
gatgtgccagccacacggacgctgaactctgtctctctgacgtccgtagctgagtccagccccgtagtctccagctttcctcaccaggacctggaaaggcggaagttcccggctttaaactagacgttcaacaagttag

SEQ ID NO: 8568 - DNA, 30 bp, Homo sapiens
  chr6:85476233-85476263
  hyper
ctagagagtttgggccgggagtgggagtgg

SEQ ID NO: 8569 - DNA, 140 bp, Homo sapiens
  chr6:85476998-85477138
  hyper
agcccactccaacctcggctcctggagaaggggcgtcgaatctctcttgggcatgggagggaaagacattccgagttggctgggcggagtggcagccttgagagtgacgagtgacagcaaagcctcgtcctagcaaggcc

SEQ ID NO: 8570 - DNA, 119 bp, Homo sapiens; identical to SEQ ID NO: 571
  chr6:85482703-85482822
  hyper

SEQ ID NO: 8571 - DNA, 30 bp, Homo sapiens
  chr6:85483316-85483346
  hyper
tcagggagcgcggaacgcgggtttctgttg

SEQ ID NO: 8572 - DNA, 173 bp, Homo sapiens
  chr6:85483759-85483932
  hyper
cgcttcaggcggtaggtgtggagtacctgggcagctccggcgggaatggtgttggggagaaggagctgtcattcatagtcttctacatatctgaataaagaattgctttttaaaaataggttcagagcctagtgagtgaaaacttaaaagtccccgcgaggagctctagttcc

SEQ ID NO: 8573 - DNA, 69 bp, Homo sapiens; identical to SEQ ID NO: 2850
  chr6:85484557-85484626
  hyper

SEQ ID NO: 8574 - DNA, 217 bp, Homo sapiens; identical to SEQ ID NO: 2851
  chr6:85484716-85484933
  hyper

SEQ ID NO: 8575 - DNA, 83 bp, Homo sapiens
  chr6:86159807-86159890
  hyper
ggcactcgcccggctcgcccgctttcgcacccagttcacgcgccacagctatgtgtccccgagccgcgcgggcgcccgcgacg

SEQ ID NO: 8576 - DNA, 171 bp, Homo sapiens
  chr6:87861962-87862133
  hyper
gcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccc

SEQ ID NO: 8577 - DNA, 30 bp, Homo sapiens
  chr6:88875485-88875515
  hyper
aaaagtatttccaaacgcaactctgccagg

SEQ ID NO: 8578 - DNA, 103 bp, Homo sapiens
  chr6:88875796-88875899
  hyper
agtggggtgtgcctccggcgggcggtcagcaagtcagtccgtccgagcgccggcgtcccggtctccagcgcccgcccgcgacagcgaccgggactggcgcccc

SEQ ID NO: 8579 - DNA, 175 bp, Homo sapiens; identical to SEQ ID NO: 2852
  chr6:88876302-88876477
  hyper

SEQ ID NO: 8580 - DNA, 111 bp, Homo sapiens; identical to SEQ ID NO: 2853
  chr6:88876630-88876741
  hyper

SEQ ID NO: 8581 - DNA, 322 bp, Homo sapiens; identical to SEQ ID NO: 2854
  chr6:88876742-88877064
  hyper

SEQ ID NO: 8582 - DNA, 208 bp, Homo sapiens; identical to SEQ ID NO: 2855
  chr6:88877065-88877273
  hyper

SEQ ID NO: 8583 - DNA, 155 bp, Homo sapiens
  chr6:90143450-90143605
  hyper
ccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaag

SEQ ID NO: 8584 - DNA, 350 bp, Homo sapiens
  chr6:91004829-91005179
  hyper
actgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 8585 - DNA, 106 bp, Homo sapiens
  chr6:91005208-91005314
  hyper
cgcccgccgccgtctccagcggcgccgggctcccgaacacccgccgggtgagcgaagcacagcggggccacggagcgcctcgacgcggggacggggagggcagtgt

SEQ ID NO: 8586 - DNA, 932 bp, Homo sapiens
  chr6:91320320-91321252
  hyper
ttatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcagtttgggcaggggagcgagggccgggaggcgtctaggctgtggcgaggggagaagcatcccccatccctccgctccccgtctcgctcaagctcttcctgcgccacgggcaggtctcccagcctcgccatcgcggggcgtccccgtcccggcccacacctctttcctctccagccacaccggcgcgccccgagggttgcaggcgggggctgcaccgggttgaagcccagtcaaccacacgtcccagggcttaggcgccgggcggggacaacgtgtctgcctgggctcagacgctgctagggggca

SEQ ID NO: 8587 - DNA, 43 bp, Homo sapiens
  chr6:94126380-94126423
  hyper
ctcggagcagagtgccgacctccctttgcgcccgcggaggcgc

SEQ ID NO: 8588 - DNA, 110 bp, Homo sapiens
  chr6:94126643-94126753
  hyper
gccaagcatccattacgcctctgccagacctgggcactccagggagccggtggcgccctcgctcgagaaggagtcgggaagaggagagtggctttcgggaagaggagagt

SEQ ID NO: 8589 - DNA, 36 bp, Homo sapiens
  chr6:94127088-94127124
  hyper
cgcctagaagccgggcgcactcgccgcccgccagcc

SEQ ID NO: 8590 - DNA, 184 bp, Homo sapiens; identical to SEQ ID NO: 2856
  chr6:94127476-94127660
  hyper

SEQ ID NO: 8591 - DNA, 39 bp, Homo sapiens
  chr6:94128439-94128478
  hyper
gtaacccgagctttccgagctcatcgaagtctcggtccc

SEQ ID NO: 8592 - DNA, 36 bp, Homo sapiens
  chr6:94128713-94128749
  hyper
ccgcgccagaaatcccgcacccgtcggatggacggc

SEQ ID NO: 8593 - DNA, 224 bp, Homo sapiens
  chr6:94129182-94129406
  hyper
cgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 8594 - DNA, 32 bp, Homo sapiens
  chr6:94129782-94129814
  hyper
tgttgttagaacctccgcgggctgggtaactt

SEQ ID NO: 8595 - DNA, 93 bp, Homo sapiens
  chr6:96463220-96463313
  hyper
gctccaaggggcaggcgatggttgccggcattgagctccctgctggcgccttctggcgggacagccagtgccaaagagcgcccagggaaacaa

SEQ ID NO: 8596 - DNA, 34 bp, Homo sapiens
  chr6:96464100-96464134
  hyper
gagagtgcagggggtcgggcgtcaaagcttggcg

SEQ ID NO: 8597 - DNA, 736 bp, Homo sapiens; identical to SEQ ID NO: 572
  chr6:99271926-99272662
  hyper

SEQ ID NO: 8598 - DNA, 30 bp, Homo sapiens
  chr6:99273871-99273901
  hyper
tttcctggactgagacgttgactggtgacc

SEQ ID NO: 8599 - DNA, 150 bp, Homo sapiens; identical to SEQ ID NO: 573
  chr6:99277180-99277330
  hyper

SEQ ID NO: 8600 - DNA, 184 bp, Homo sapiens
  chr6:99279556-99279740
  hyper
caaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattggg

SEQ ID NO: 8601 - DNA, 194 bp, Homo sapiens
  chr6:99280516-99280710
  hyper
cggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcag

SEQ ID NO: 8602 - DNA, 1 bp, Homo sapiens
  chr6:99281036-99281037
  hyper
g

SEQ ID NO: 8603 - DNA, 79 bp, Homo sapiens
  chr6:99281067-99281146
  hyper
cgcgcccaagttctagctaccgggcttgcaggctcggaaactcgcaggcggcacctgctctgggcggctaaagaactga

SEQ ID NO: 8604 - DNA, 123 bp, Homo sapiens
  chr6:99281355-99281478
  hyper
ttcccaaggggctaacggaaaagttgcacctaccagcggtaggagcacggggaatcgcgcacgcaggccctccgcgcggcttcccggagcggcctttggcgactgcgccgcccctacaaggcc

SEQ ID NO: 8605 - DNA, 95 bp, Homo sapiens
  chr6:99282778-99282873
  hyper
cctgctcacctccagcgcctccatcgtgcacgccgagccgcccggcggcatgcagcagggcgcggggggctaccgcgaagcgcagagcctggtgc

SEQ ID NO: 8606 - DNA, 98 bp, Homo sapiens
  chr6:99283408-99283506
  hyper
cgagccacaccatgccgaccaccacccgcacccgcactcgcacccacaccagcagccgccgcccccgccgcccccgcagggtccgcctggccacccag

SEQ ID NO: 8607 - DNA, 113 bp, Homo sapiens
  chr6:99290360-99290473
  hyper
ctcggggaccctggccgctgtcgcgaaggcccagacagcctagctcggccgcgcggggaggagagagacagggaaaggagcggggcactccctgcactcccagccccggcctt

SEQ ID NO: 8608 - DNA, 30 bp, Homo sapiens
  chr6:99291312-99291342
  hyper
ccagagctgagggcccggaaagtgaggggc

SEQ ID NO: 8609 - DNA, 269 bp, Homo sapiens
  chr6:99292252-99292521
  hyper
agcctggtctcccagcgccgtgcccgccgcccccgccccatcctgcgccccagatgcgcgccccgcttggaccagtccgagcagaggggggttccgaaatctgctcggacgcagcatcgctggccgcctgccccgctagttccccgagtgcgattactttttaaaggctcctttaagcatatttccgtgaatctgtttcttgtgctttaatgttactattaattgataagatcagctcatcaaacatactatttcgatagggaattgta

SEQ ID NO: 8610 - DNA, 105 bp, Homo sapiens; identical to SEQ ID NO: 574
  chr6:99295759-99295864
  hyper

SEQ ID NO: 8611 - DNA, 304 bp, Homo sapiens; identical to SEQ ID NO: 575
  chr6:99296061-99296365
  hyper

SEQ ID NO: 8612 - DNA, 49 bp, Homo sapiens; identical to SEQ ID NO: 576
  chr6:99296407-99296456
  hyper

SEQ ID NO: 8613 - DNA, 46 bp, Homo sapiens; identical to SEQ ID NO: 577
  chr6:100038661-100038707
  hyper

SEQ ID NO: 8614 - DNA, 369 bp, Homo sapiens; identical to SEQ ID NO: 578
  chr6:100038785-100039154
  hyper

SEQ ID NO: 8615 - DNA, 251 bp, Homo sapiens; identical to SEQ ID NO: 579
  chr6:100050858-100051109
  hyper

SEQ ID NO: 8616 - DNA, 149 bp, Homo sapiens; identical to SEQ ID NO: 580
  chr6:100051359-100051508
  hyper

SEQ ID NO: 8617 - DNA, 187 bp, Homo sapiens; identical to SEQ ID NO: 581
  chr6:100051771-100051958
  hyper

SEQ ID NO: 8618 - DNA, 212 bp, Homo sapiens
  chr6:100053299-100053511
  hyper
ggtgtcgccaccttgcgtcctgccacccttgctaaccacaatcgctccagcactttcagccgacaaagcctcgaggagaagctagcgtgggcgctgctgagggccctctgcccttttgtgcagtggttgggcctctggcgctaggcttggaaatacaccaccactcaggcctctcttggaagaactgcatcgggctccggtgctggctgcat

SEQ ID NO: 8619 - DNA, 70 bp, Homo sapiens
  chr6:100054866-100054936
  hyper
aggacctggagcacccgagcgcctgcctggtggcggcggcaacaatgcacggagccgccagagcgccagc

SEQ ID NO: 8620 - DNA, 52 bp, Homo sapiens
  chr6:100055281-100055333
  hyper
gtggggtgcactgagcgctgtaggtgccgggaccattcgcagcttgtgtttt

SEQ ID NO: 8621 - DNA, 430 bp, Homo sapiens; identical to SEQ ID NO: 2867
  chr6:100061022-100061452
  hyper

SEQ ID NO: 8622 - DNA, 682 bp, Homo sapiens; identical to SEQ ID NO: 2868
  chr6:100061988-100062670
  hyper

SEQ ID NO: 8623 - DNA, 178 bp, Homo sapiens
  chr6:100062910-100063088
  hyper
cctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 8624 - DNA, 39 bp, Homo sapiens
  chr6:100067144-100067183
  hyper
cgccggcgccatcgcgaggtcaagcgtgacccttggcca

SEQ ID NO: 8625 - DNA, 30 bp, Homo sapiens
  chr6:100067397-100067427
  hyper
ccttcaaaaagggaccgaaagtgggtggac

SEQ ID NO: 8626 - DNA, 2 bp, Homo sapiens
  chr6:100441306-100441308
  hyper
cg

SEQ ID NO: 8627 - DNA, 241 bp, Homo sapiens; identical to SEQ ID NO: 583
  chr6:100441497-100441738
  hyper

SEQ ID NO: 8628 - DNA, 337 bp, Homo sapiens; identical to SEQ ID NO: 584
  chr6:100441761-100442098
  hyper

SEQ ID NO: 8629 - DNA, 21 bp, Homo sapiens
  chr6:100903384-100903405
  hyper
tctctttctaaatcccggctc

SEQ ID NO: 8630 - DNA, 90 bp, Homo sapiens
  chr6:100905969-100906059
  hyper
cgagtttgggcttcccgtagggatagagcctgcgggccaacctggctgcccgagttggagccagccgcgaaaagacggcagaaacccaag

SEQ ID NO: 8631 - DNA, 43 bp, Homo sapiens
  chr6:100912403-100912446
  hyper
gggtgggaggcgccgcggcctctcccacaccaccgcggagctg

SEQ ID NO: 8632 - DNA, 15 bp, Homo sapiens
  chr6:100912465-100912480
  hyper
cggggcgtcttctgc

SEQ ID NO: 8633 - DNA, 132 bp, Homo sapiens; identical to SEQ ID NO: 585
  chr6:100912919-100913051
  hyper

SEQ ID NO: 8634 - DNA, 30 bp, Homo sapiens
  chr6:100915720-100915750
  hyper
agaaagaagggggagcgggcacctcaaggg

SEQ ID NO: 8635 - DNA, 59 bp, Homo sapiens; identical to SEQ ID NO: 2874
  chr6:101840708-101840767
  hyper

SEQ ID NO: 8636 - DNA, 238 bp, Homo sapiens
  chr6:101841128-101841366
  hyper
gcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtc

SEQ ID NO: 8637 - DNA, 54 bp, Homo sapiens
  chr6:101841599-101841653
  hyper
ggcggctgcgctggtcggtctggtagctggggacttttccgcccgacctcctcc

SEQ ID NO: 8638 - DNA, 30 bp, Homo sapiens
  chr6:101850180-101850210
  hyper
gacacatgcgccctccgggtgcatttggca

SEQ ID NO: 8639 - DNA, 104 bp, Homo sapiens; identical to SEQ ID NO: 586
  chr6:105389509-105389613
  hyper

SEQ ID NO: 8640 - DNA, 30 bp, Homo sapiens
  chr6:105400913-105400943
  hyper
tgtcaagaaagttaccgccaagtggtttac

SEQ ID NO: 8641 - DNA, 161 bp, Homo sapiens; identical to SEQ ID NO: 2876
  chr6:105401596-105401757
  hyper

SEQ ID NO: 8642 - DNA, 111 bp, Homo sapiens
  chr6:105404519-105404630
  hyper
taaatatgaaattagcgttccaagcaggtttactgccatggaatagctgaattcttaaggggaaaaaaagcgttaacatcggttgttttatttaaacgaccccctcccatg

SEQ ID NO: 8643 - DNA, 380 bp, Homo sapiens
  chr6:105405656-105406036
  hyper
atacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaat

SEQ ID NO: 8644 - DNA, 30 bp, Homo sapiens
  chr6:105406435-105406465
  hyper
tgttcttgttgtttccggtattacctatac

SEQ ID NO: 8645 - DNA, 83 bp, Homo sapiens; identical to SEQ ID NO: 587
  chr6:105584133-105584216
  hyper

SEQ ID NO: 8646 - DNA, 103 bp, Homo sapiens; identical to SEQ ID NO: 588
  chr6:105584217-105584320
  hyper

SEQ ID NO: 8647 - DNA, 185 bp, Homo sapiens; identical to SEQ ID NO: 589
  chr6:105584366-105584551
  hyper

SEQ ID NO: 8648 - DNA, 1015 bp, Homo sapiens; identical to SEQ ID NO: 590
  chr6:105584552-105585567
  hyper

SEQ ID NO: 8649 - DNA, 420 bp, Homo sapiens
  chr6:105627657-105628077
  hyper
gacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaa

SEQ ID NO: 8650 - DNA, 427 bp, Homo sapiens; identical to SEQ ID NO: 591
  chr6:106429049-106429476
  hyper

SEQ ID NO: 8651 - DNA, 35 bp, Homo sapiens; identical to SEQ ID NO: 592
  chr6:106429589-106429624
  hyper

SEQ ID NO: 8652 - DNA, 47 bp, Homo sapiens
  chr6:106434211-106434258
  hyper
tctcgggcacacgcgcggcttctgcccacccgcgtaaatgccctggg

SEQ ID NO: 8653 - DNA, 1251 bp, Homo sapiens; identical to SEQ ID NO: 593
  chr6:106441869-106443120
  hyper

SEQ ID NO: 8654 - DNA, 151 bp, Homo sapiens
  chr6:106960833-106960984
  hyper
tggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctc

SEQ ID NO: 8655 - DNA, 34 bp, Homo sapiens
  chr6:108434966-108435000
  hyper
cctcggggtcggagtcgcccgagtggagactgga

SEQ ID NO: 8656 - DNA, 715 bp, Homo sapiens; identical to SEQ ID NO: 2884
  chr6:108436072-108436787
  hyper

SEQ ID NO: 8657 - DNA, 15 bp, Homo sapiens
  chr6:108438142-108438157
  hyper
gcagcccaactgggg

SEQ ID NO: 8658 - DNA, 303 bp, Homo sapiens; identical to SEQ ID NO: 595
  chr6:108438260-108438563
  hyper

SEQ ID NO: 8659 - DNA, 53 bp, Homo sapiens
  chr6:108438779-108438832
  hyper
catgtgatgtgtgagcggtgtgtgatgtgcgtgtggtgcgaagaggggaggtg

SEQ ID NO: 8660 - DNA, 567 bp, Homo sapiens; identical to SEQ ID NO: 596
  chr6:108440078-108440645
  hyper

SEQ ID NO: 8661 - DNA, 223 bp, Homo sapiens; identical to SEQ ID NO: 597
  chr6:108440744-108440967
  hyper

SEQ ID NO: 8662 - DNA, 822 bp, Homo sapiens; identical to SEQ ID NO: 2889
  chr6:108478874-108479696
  hyper

SEQ ID NO: 8663 - DNA, 246 bp, Homo sapiens; identical to SEQ ID NO: 2890
  chr6:108484872-108485118
  hyper

SEQ ID NO: 8664 - DNA, 494 bp, Homo sapiens; identical to SEQ ID NO: 2891
  chr6:108485513-108486007
  hyper

SEQ ID NO: 8665 - DNA, 386 bp, Homo sapiens; identical to SEQ ID NO: 2892
  chr6:108486008-108486394
  hyper

SEQ ID NO: 8666 - DNA, 38 bp, Homo sapiens
  chr6:108487419-108487457
  hyper
tctgcgcttgggttccggcagcgcggagcccgtctgcc

SEQ ID NO: 8667 - DNA, 665 bp, Homo sapiens; identical to SEQ ID NO: 598
  chr6:108487779-108488444
  hyper

SEQ ID NO: 8668 - DNA, 79 bp, Homo sapiens; identical to SEQ ID NO: 599
  chr6:108489730-108489809
  hyper

SEQ ID NO: 8669 - DNA, 180 bp, Homo sapiens; identical to SEQ ID NO: 600
  chr6:108490066-108490246
  hyper

SEQ ID NO: 8670 - DNA, 219 bp, Homo sapiens; identical to SEQ ID NO: 601
  chr6:108490296-108490515
  hyper

SEQ ID NO: 8671 - DNA, 60 bp, Homo sapiens; identical to SEQ ID NO: 602
  chr6:108490537-108490597
  hyper

SEQ ID NO: 8672 - DNA, 41 bp, Homo sapiens; identical to SEQ ID NO: 2898
  chr6:108490960-108491001
  hyper

SEQ ID NO: 8673 - DNA, 36 bp, Homo sapiens
  chr6:108491374-108491410
  hyper
agtccccaacccaagcgctttcggcagcagctgtcg

SEQ ID NO: 8674 - DNA, 290 bp, Homo sapiens
  chr6:108492251-108492541
  hyper
tcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgct

SEQ ID NO: 8675 - DNA, 551 bp, Homo sapiens; identical to SEQ ID NO: 603
  chr6:108495915-108496466
  hyper

SEQ ID NO: 8676 - DNA, 39 bp, Homo sapiens
  chr6:110299546-110299585
  hyper
cgcttgcctcctccccggcccggccgcctcctgcaggca

SEQ ID NO: 8677 - DNA, 460 bp, Homo sapiens; identical to SEQ ID NO: 2900
  chr6:110678940-110679400
  hyper

SEQ ID NO: 8678 - DNA, 265 bp, Homo sapiens; identical to SEQ ID NO: 2901
  chr6:110679401-110679666
  hyper

SEQ ID NO: 8679 - DNA, 103 bp, Homo sapiens
  chr6:111409667-111409770
  hyper
ttttgtggtctctttcgtgactatgccagttatgtagttcttcacctgcctccctgggccgcagaggggtgtgcgtatgttggcggggcggggggtggagttt

SEQ ID NO: 8680 - DNA, 30 bp, Homo sapiens
  chr6:114663242-114663272
  hyper
tttgctggcatcacccggatgcttcccttt

SEQ ID NO: 8681 - DNA, 208 bp, Homo sapiens; identical to SEQ ID NO: 604
  chr6:117086271-117086479
  hyper

SEQ ID NO: 8682 - DNA, 160 bp, Homo sapiens; identical to SEQ ID NO: 605
  chr6:117086480-117086640
  hyper

SEQ ID NO: 8683 - DNA, 55 bp, Homo sapiens; identical to SEQ ID NO: 2904
  chr6:117586007-117586062
  hyper

SEQ ID NO: 8684 - DNA, 36 bp, Homo sapiens
  chr6:117586401-117586437
  hyper
gagcccggatcccttcgtccccgcctccttctctct

SEQ ID NO: 8685 - DNA, 30 bp, Homo sapiens
  chr6:117587193-117587223
  hyper
tcgcctgtttgctctcgggaagcagctaag

SEQ ID NO: 8686 - DNA, 30 bp, Homo sapiens
  chr6:117587572-117587602
  hyper
taattttttcctttgcgaagttctgggagc

SEQ ID NO: 8687 - DNA, 310 bp, Homo sapiens; identical to SEQ ID NO: 606
  chr6:117591206-117591516
  hyper

SEQ ID NO: 8688 - DNA, 75 bp, Homo sapiens
  chr6:117591753-117591828
  hyper
atagcgcgtaccaggcgccagtgcccccgccgctgggcagccctctggccaccgcgcactcggagctgcccttcg

SEQ ID NO: 8689 - DNA, 39 bp, Homo sapiens
  chr6:117592099-117592138
  hyper
cggcagtcctccctgcgagctctccggcaaaggcgagcc

SEQ ID NO: 8690 - DNA, 130 bp, Homo sapiens
  chr6:118228102-118228232
  hyper
ggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 8691 - DNA, 218 bp, Homo sapiens; identical to SEQ ID NO: 2906
  chr6:118228651-118228869
  hyper

SEQ ID NO: 8692 - DNA, 344 bp, Homo sapiens; identical to SEQ ID NO: 2907
  chr6:118228870-118229214
  hyper

SEQ ID NO: 8693 - DNA, 37 bp, Homo sapiens; identical to SEQ ID NO: 607
  chr6:118229695-118229732
  hyper

SEQ ID NO: 8694 - DNA, 91 bp, Homo sapiens; identical to SEQ ID NO: 608
  chr6:118229733-118229824
  hyper

SEQ ID NO: 8695 - DNA, 74 bp, Homo sapiens
  chr6:118241235-118241309
  hyper
gtgacgccgggttcccggggctggctggagtctctgtacctatctggatcctgctgcaggccggggaaacactg

SEQ ID NO: 8696 - DNA, 45 bp, Homo sapiens
  chr6:119399159-119399204
  hyper
ttttggaggtgtctccggctgttgcttcggcggaggagtagagtt

SEQ ID NO: 8697 - DNA, 90 bp, Homo sapiens
  chr6:121758632-121758722
  hyper
ttcccgagaatgaggcggggcggctcaaggggaaagggcagggaggagagaccctcgggaagctgatgacgcgtccggggcaagtcagcc

SEQ ID NO: 8698 - DNA, 35 bp, Homo sapiens; identical to SEQ ID NO: 2910
  chr6:123316972-123317007
  hyper

SEQ ID NO: 8699 - DNA, 642 bp, Homo sapiens; identical to SEQ ID NO: 2911
  chr6:123317072-123317714
  hyper

SEQ ID NO: 8700 - DNA, 156 bp, Homo sapiens; identical to SEQ ID NO: 2912
  chr6:123317715-123317871
  hyper

SEQ ID NO: 8701 - DNA, 292 bp, Homo sapiens
  chr6:124124311-124124603
  hyper
ccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttg

SEQ ID NO: 8702 - DNA, 87 bp, Homo sapiens
  chr6:124124879-124124966
  hyper
ctcgcgcgcttctgccgcccccggagccggcgcgcggcgagcgcagggcgagcgcgcgtcgggcggcggccgcgctggggggcgtga

SEQ ID NO: 8703 - DNA, 47 bp, Homo sapiens
  chr6:125282746-125282793
  hyper
tcgaaagtgctttttcgattatttatgggtttcgaagattcttccta

SEQ ID NO: 8704 - DNA, 269 bp, Homo sapiens
  chr6:125283133-125283402
  hyper
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggg

SEQ ID NO: 8705 - DNA, 239 bp, Homo sapiens
  chr6:125283925-125284164
  hyper
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgcc

SEQ ID NO: 8706 - DNA, 33 bp, Homo sapiens
  chr6:125475551-125475584
  hyper
agtgagaggatcgcccgccgagggggtggctcc

SEQ ID NO: 8707 - DNA, 94 bp, Homo sapiens
  chr6:125684588-125684682
  hyper
aaataaaggcctccccgcacagccagccagcttcgttcattcacgtcaccgacaaacactcctagcaggcgttgttaaacgttcagggagcgcc

SEQ ID NO: 8708 - DNA, 110 bp, Homo sapiens; identical to SEQ ID NO: 2913
  chr6:126068068-126068178
  hyper

SEQ ID NO: 8709 - DNA, 33 bp, Homo sapiens
  chr6:126069106-126069139
  hyper
agccccacctggccccgccgagtgtgtgctttg

SEQ ID NO: 8710 - DNA, 225 bp, Homo sapiens
  chr6:126069350-126069575
  hyper
cccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaac

SEQ ID NO: 8711 - DNA, 51 bp, Homo sapiens
  chr6:126069805-126069856
  hyper
ccaatcttcacctcccggactctaactctgcggctgcgagtgcatacacca

SEQ ID NO: 8712 - DNA, 42 bp, Homo sapiens
  chr6:126071276-126071318
  hyper
tgtcacagttggacgcgcgaacggcagcgtctgggcgacagg

SEQ ID NO: 8713 - DNA, 23 bp, Homo sapiens
  chr6:127439250-127439273
  hyper
gggagagggtagttgcgcgccgg

SEQ ID NO: 8714 - DNA, 166 bp, Homo sapiens
  chr6:127439321-127439487
  hyper
cggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttcccc

SEQ ID NO: 8715 - DNA, 354 bp, Homo sapiens
  chr6:127439838-127440192
  hyper
acgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacag

SEQ ID NO: 8716 - DNA, 104 bp, Homo sapiens; identical to SEQ ID NO: 2914
  chr6:127440406-127440510
  hyper

SEQ ID NO: 8717 - DNA, 452 bp, Homo sapiens; identical to SEQ ID NO: 2915
  chr6:127440511-127440963
  hyper

SEQ ID NO: 8718 - DNA, 703 bp, Homo sapiens; identical to SEQ ID NO: 2916
  chr6:127441030-127441733
  hyper

SEQ ID NO: 8719 - DNA, 50 bp, Homo sapiens
  chr6:127442021-127442071
  hyper
cccactctttcattccggcccggacgcggaaggggaggcctggggttcag

SEQ ID NO: 8720 - DNA, 190 bp, Homo sapiens
  chr6:127442089-127442279
  hyper
cggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccac

SEQ ID NO: 8721 - DNA, 329 bp, Homo sapiens
  chr6:127836715-127837044
  hyper
ctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccg

SEQ ID NO: 8722 - DNA, 223 bp, Homo sapiens
  chr6:127837399-127837622
  hyper
aggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtcc

SEQ ID NO: 8723 - DNA, 69 bp, Homo sapiens
  chr6:127840624-127840693
  hyper
gacaaagggttcttgcgaagccacgactaatttagtgcaaaccgaaataaatatcggcccacagagatc

SEQ ID NO: 8724 - DNA, 30 bp, Homo sapiens
  chr6:129204494-129204524
  hyper
gcaaagaggtacagtcgaggcatgggcttg

SEQ ID NO: 8725 - DNA, 764 bp, Homo sapiens; identical to SEQ ID NO: 2917
  chr6:130686429-130687193
  hyper

SEQ ID NO: 8726 - DNA, 120 bp, Homo sapiens; identical to SEQ ID NO: 2918
  chr6:130687224-130687344
  hyper

SEQ ID NO: 8727 - DNA, 166 bp, Homo sapiens
  chr6:130687620-130687786
  hyper
gagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccag

SEQ ID NO: 8728 - DNA, 324 bp, Homo sapiens
  chr6:132722157-132722481
  hyper
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggt

SEQ ID NO: 8729 - DNA, 63 bp, Homo sapiens; identical to SEQ ID NO: 2919
  chr6:133562374-133562437
  hyper

SEQ ID NO: 8730 - DNA, 408 bp, Homo sapiens; identical to SEQ ID NO: 2920
  chr6:133562674-133563082
  hyper

SEQ ID NO: 8731 - DNA, 604 bp, Homo sapiens; identical to SEQ ID NO: 609
  chr6:133563411-133564015
  hyper

SEQ ID NO: 8732 - DNA, 30 bp, Homo sapiens
  chr6:134175985-134176015
  hyper
gcggcgagtctcccccggaggtctaggagg

SEQ ID NO: 8733 - DNA, 437 bp, Homo sapiens; identical to SEQ ID NO: 610
  chr6:134210582-134211019
  hyper

SEQ ID NO: 8734 - DNA, 224 bp, Homo sapiens; identical to SEQ ID NO: 611
  chr6:134211111-134211335
  hyper

SEQ ID NO: 8735 - DNA, 30 bp, Homo sapiens
  chr6:134214334-134214364
  hyper
ccacaggccgcttcgcgggtggagccctct

SEQ ID NO: 8736 - DNA, 97 bp, Homo sapiens
  chr6:134216904-134217001
  hyper
ggccttgctctggtccggcactgtgtgcgtcgggaagtcggcctggagttggggttgcagggacgccacggctggtggcgagcgcagcaggagtgcc

SEQ ID NO: 8737 - DNA, 30 bp, Homo sapiens
  chr6:134217399-134217429
  hyper
gcgtttggaggaacacgcctttgatctttg

SEQ ID NO: 8738 - DNA, 281 bp, Homo sapiens
  chr6:134499571-134499852
  hyper
gggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccactt

SEQ ID NO: 8739 - DNA, 95 bp, Homo sapiens
  chr6:134638851-134638946
  hyper
caggaccctgggggccggacggtgggatacggccaatctccggggagatgctgtggctcttaccgagcgggagaagggtacgcctccccgccccc

SEQ ID NO: 8740 - DNA, 155 bp, Homo sapiens
  chr6:137241907-137242062
  hyper
ggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatc

SEQ ID NO: 8741 - DNA, 100 bp, Homo sapiens
  chr6:137242063-137242163
  hyper
cctgaaaaccaaactgtctggcgcttaacggttacctcggctgagcgaaacccttggctgctgctgatttaactacaggtccgcgcgagttactttccag

SEQ ID NO: 8742 - DNA, 44 bp, Homo sapiens
  chr6:137242390-137242434
  hyper
cagttccctgggatccggagaacgccacgcggagtctccctgca

SEQ ID NO: 8743 - DNA, 35 bp, Homo sapiens; identical to SEQ ID NO: 612
  chr6:137244114-137244149
  hyper

SEQ ID NO: 8744 - DNA, 231 bp, Homo sapiens; identical to SEQ ID NO: 613
  chr6:137244235-137244466
  hyper

SEQ ID NO: 8745 - DNA, 97 bp, Homo sapiens
  chr6:137311283-137311380
  hyper
actcgctccggattccgaacccgagagcagagcagagggaagcccctttgctgagcagctccttagtggagggcaatgaacgcgctgaaatcccaga

SEQ ID NO: 8746 - DNA, 86 bp, Homo sapiens
  chr6:137808768-137808854
  hyper
gccataaaatgcacccgcgccaccctccatgtcccccagtggaattgaggatcttgcttgtggcaaaagtgcgttcttggcaccac

SEQ ID NO: 8747 - DNA, 258 bp, Homo sapiens; identical to SEQ ID NO: 614
  chr6:137809108-137809366
  hyper

SEQ ID NO: 8748 - DNA, 472 bp, Homo sapiens; identical to SEQ ID NO: 615
  chr6:137809445-137809917
  hyper

SEQ ID NO: 8749 - DNA, 929 bp, Homo sapiens; identical to SEQ ID NO: 616
  chr6:137810032-137810961
  hyper

SEQ ID NO: 8750 - DNA, 30 bp, Homo sapiens
  chr6:137814359-137814389
  hyper
ggaggctgcgggccccggagcctgccctcc

SEQ ID NO: 8751 - DNA, 15 bp, Homo sapiens
  chr6:137814604-137814619
  hyper
cccagtgctggaagc

SEQ ID NO: 8752 - DNA, 110 bp, Homo sapiens; identical to SEQ ID NO: 2930
  chr6:137814653-137814763
  hyper

SEQ ID NO: 8753 - DNA, 151 bp, Homo sapiens; identical to SEQ ID NO: 617
  chr6:137815020-137815171
  hyper

SEQ ID NO: 8754 - DNA, 515 bp, Homo sapiens; identical to SEQ ID NO: 618
  chr6:137815224-137815739
  hyper

SEQ ID NO: 8755 - DNA, 777 bp, Homo sapiens; identical to SEQ ID NO: 619
  chr6:137816459-137817236
  hyper

SEQ ID NO: 8756 - DNA, 198 bp, Homo sapiens
  chr6:137818062-137818260
  hyper
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggac

SEQ ID NO: 8757 - DNA, 94 bp, Homo sapiens; identical to SEQ ID NO: 620
  chr6:137818505-137818599
  hyper

SEQ ID NO: 8758 - DNA, 649 bp, Homo sapiens; identical to SEQ ID NO: 621
  chr6:137818618-137819267
  hyper

SEQ ID NO: 8759 - DNA, 280 bp, Homo sapiens; identical to SEQ ID NO: 622
  chr6:137819268-137819548
  hyper

SEQ ID NO: 8760 - DNA, 30 bp, Homo sapiens
  chr6:142409862-142409892
  hyper
cgatttaggtttaatcgatgtccctccctc

SEQ ID NO: 8761 - DNA, 148 bp, Homo sapiens
  chr6:146349536-146349684
  hyper
ccagggtcctgaaggcggcagggctcaggctgccgcggcgagagcaacccggaagctcccctccgttccctttctagcaactatgcaaaccccaaagcaagcgcaggaccccccctaacccgtccacccaccgcgggaaacaagttac

SEQ ID NO: 8762 - DNA, 165 bp, Homo sapiens; identical to SEQ ID NO: 2937
  chr6:146755496-146755661
  hyper

SEQ ID NO: 8763 - DNA, 134 bp, Homo sapiens
  chr6:149069231-149069365
  hyper
tcccgtcccgcgccccggggagtgtgggtgggtttagccctttgccaccgtccgctctgagaattctgtcccgcagatcccccgcctgcccgccggccctagtggctccgcgctgtccccgggctggcttgtcc

SEQ ID NO: 8764 - DNA, 30 bp, Homo sapiens
  chr6:150284761-150284791
  hyper
tgtcgctggcgcaggcggtgacagggagac

SEQ ID NO: 8765 - DNA, 52 bp, Homo sapiens; identical to SEQ ID NO: 623
  chr6:150285317-150285369
  hyper

SEQ ID NO: 8766 - DNA, 342 bp, Homo sapiens; identical to SEQ ID NO: 624
  chr6:150285544-150285886
  hyper

SEQ ID NO: 8767 - DNA, 429 bp, Homo sapiens; identical to SEQ ID NO: 625
  chr6:150286099-150286528
  hyper

SEQ ID NO: 8768 - DNA, 152 bp, Homo sapiens
  chr6:150311146-150311298
  hyper
gctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcc

SEQ ID NO: 8769 - DNA, 170 bp, Homo sapiens
  chr6:150311893-150312063
  hyper
tttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgcc

SEQ ID NO: 8770 - DNA, 99 bp, Homo sapiens
  chr6:150359094-150359193
  hyper
gtggggtgaggagcacggggttcctacttcatcctcgcggaaactttgccaccggctcagtgtggagacctcaccgtcccgcttggatccgtggggctc

SEQ ID NO: 8771 - DNA, 15 bp, Homo sapiens
  chr6:150359438-150359453
  hyper
cgggagaaagggaga

SEQ ID NO: 8772 - DNA, 325 bp, Homo sapiens
  chr6:151561016-151561341
  hyper
gtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 8773 - DNA, 624 bp, Homo sapiens
  chr6:151561368-151561992
  hyper
cgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtg

SEQ ID NO: 8774 - DNA, 387 bp, Homo sapiens
  chr6:151562056-151562443
  hyper
cgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagc

SEQ ID NO: 8775 - DNA, 113 bp, Homo sapiens
  chr6:151815244-151815357
  hyper
cccccgggctcgggtcgtcatgagcctggactgcaccagccatatcgcgctgggtgccgcttcgccagcgcccgaggtacggtcccagccgccggccgcgcgcgggggtggcc

SEQ ID NO: 8776 - DNA, 412 bp, Homo sapiens
  chr6:152622937-152623349
  hyper
gaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcat

SEQ ID NO: 8777 - DNA, 90 bp, Homo sapiens
  chr6:152957532-152957622
  hyper
taatagggacatctacgtacgagatgcaaagaggctccccaacctcctagtctccttatctatgagtatcgcacacgtacacacatcact

SEQ ID NO: 8778 - DNA, 46 bp, Homo sapiens
  chr6:152957953-152957999
  hyper
acaacaatctcagcccgctgcggccggcggccgcggcccggcgccc

SEQ ID NO: 8779 - DNA, 285 bp, Homo sapiens
  chr6:152958000-152958285
  hyper
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagag

SEQ ID NO: 8780 - DNA, 356 bp, Homo sapiens
  chr6:153450977-153451333
  hyper
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccag

SEQ ID NO: 8781 - DNA, 158 bp, Homo sapiens
  chr6:153451810-153451968
  hyper
tcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcg

SEQ ID NO: 8782 - DNA, 171 bp, Homo sapiens
  chr6:153452584-153452755
  hyper
ggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 8783 - DNA, 136 bp, Homo sapiens
  chr6:154360584-154360720
  hyper
agcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcac

SEQ ID NO: 8784 - DNA, 74 bp, Homo sapiens; identical to SEQ ID NO: 2941
  chr6:155316256-155316330
  hyper

SEQ ID NO: 8785 - DNA, 533 bp, Homo sapiens; identical to SEQ ID NO: 626
  chr6:157556764-157557297
  hyper

SEQ ID NO: 8786 - DNA, 30 bp, Homo sapiens
  chr6:158430625-158430655
  hyper
aagcaaagacattctcgtgtaggaaaactt

SEQ ID NO: 8787 - DNA, 53 bp, Homo sapiens
  chr6:158957871-158957924
  hyper
cccttcaaggatgaccgctactacaggtgggcgcggcgcgggcagcggcgggg

SEQ ID NO: 8788 - DNA, 39 bp, Homo sapiens; identical to SEQ ID NO: 2943
  chr6:159590048-159590087
  hyper

SEQ ID NO: 8789 - DNA, 608 bp, Homo sapiens; identical to SEQ ID NO: 2944
  chr6:159590154-159590762
  hyper

SEQ ID NO: 8790 - DNA, 278 bp, Homo sapiens; identical to SEQ ID NO: 2945
  chr6:159590971-159591249
  hyper

SEQ ID NO: 8791 - DNA, 90 bp, Homo sapiens
  chr6:159654913-159655003
  hyper
gaccacaggtcccagcgcggacatgcggcctcccccgccaggcccagccgacccggcggcccccagtcccgcgcccgggtacccagcagg

SEQ ID NO: 8792 - DNA, 187 bp, Homo sapiens
  chr6:161351859-161352046
  hyper
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagt

SEQ ID NO: 8793 - DNA, 95 bp, Homo sapiens
  chr6:163836610-163836705
  hyper
caagttggcgcgttgcggagggctgcggggtgagccctgcggcccctctagcttcggcggtcacatttccgagaggtcggcgggggctgcgcgga

SEQ ID NO: 8794 - DNA, 136 bp, Homo sapiens
  chr6:166074525-166074661
  hyper
cctgcttccttctagcgaacccctgccttgacttttctgctcaatcttgtcccccacccccgtgacatgcctttctgccacctctgcctcagcgcgctctcggccccgcgcccgcgggtggcgaggaggagtggcc

SEQ ID NO: 8795 - DNA, 163 bp, Homo sapiens
  chr6:166074962-166075125
  hyper
tggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 8796 - DNA, 30 bp, Homo sapiens
  chr6:166075459-166075489
  hyper
ccttcggaagcagctcgcattattagaagg

SEQ ID NO: 8797 - DNA, 50 bp, Homo sapiens
  chr6:166077583-166077633
  hyper
cgaggtcaccttccccggagtggagcacacgcgccaaagctcagctttca

SEQ ID NO: 8798 - DNA, 39 bp, Homo sapiens
  chr6:166077961-166078000
  hyper
gcagattctgagtgtcgcgtgtaacgggcatcagacttg

SEQ ID NO: 8799 - DNA, 116 bp, Homo sapiens
  chr6:166218546-166218662
  hyper
tggagggacatggggcgtacggaggggcagcggggcctggggtcgagcagaggggcgcatggaggggagcatggagggacgtggggcgcgcggaggggcggcggggcgtgggacgc

SEQ ID NO: 8800 - DNA, 350 bp, Homo sapiens; identical to SEQ ID NO: 2946
  chr6:166267542-166267892
  hyper

SEQ ID NO: 8801 - DNA, 30 bp, Homo sapiens
  chr6:166400601-166400631
  hyper
ctcgggaggcacctgcgggtctggcgcggc

SEQ ID NO: 8802 - DNA, 30 bp, Homo sapiens
  chr6:166400920-166400950
  hyper
gtttttttaagtacacgcacacacacacaa

SEQ ID NO: 8803 - DNA, 30 bp, Homo sapiens
  chr6:166401268-166401298
  hyper
gcgcgccgatcttctcgcaaaaggcgagtg

SEQ ID NO: 8804 - DNA, 256 bp, Homo sapiens; identical to SEQ ID NO: 2947
  chr6:166402395-166402651
  hyper

SEQ ID NO: 8805 - DNA, 49 bp, Homo sapiens; identical to SEQ ID NO: 2948
  chr6:166421943-166421992
  hyper

SEQ ID NO: 8806 - DNA, 192 bp, Homo sapiens; identical to SEQ ID NO: 2949
  chr6:166421993-166422185
  hyper

SEQ ID NO: 8807 - DNA, 1231 bp, Homo sapiens; identical to SEQ ID NO: 627
  chr6:166579715-166580946
  hyper

SEQ ID NO: 8808 - DNA, 1021 bp, Homo sapiens; identical to SEQ ID NO: 628
  chr6:166581218-166582239
  hyper

SEQ ID NO: 8809 - DNA, 292 bp, Homo sapiens; identical to SEQ ID NO: 2952
  chr6:166582505-166582797
  hyper

SEQ ID NO: 8810 - DNA, 18 bp, Homo sapiens
  chr6:166583078-166583096
  hyper
ctcatttgctcctgacgc

SEQ ID NO: 8811 - DNA, 88 bp, Homo sapiens
  chr6:166583152-166583240
  hyper
cgtggtgcgtgttactctccttactccgggtattaaaatgtctaagaggtcatcgctttggcccaaggcctcccgaggataagataaa

SEQ ID NO: 8812 - DNA, 91 bp, Homo sapiens
  chr6:166666972-166667063
  hyper
ccagggagaaagctccggtgaggggagcagacgctgggacccgtggtctcgccctctgctctttcctggctggggacgggggtagctccca

SEQ ID NO: 8813 - DNA, 34 bp, Homo sapiens
  chr6:168841594-168841628
  hyper
gtgtgtgtgagagtgcgcgcggggaaggaggcac

SEQ ID NO: 8814 - DNA, 80 bp, Homo sapiens
  chr6:168842084-168842164
  hyper
tcgctgggctgctcccgccggtgcccgctcagaagttctcggcgctcacggtaagcccgggcccgcgggacctggagctc

SEQ ID NO: 8815 - DNA, 57 bp, Homo sapiens
  chr6:169653992-169654049
  hyper
tgtcaatcagacacacgaggaagcacgtttaattcattccttcgaaggaatgacatc

SEQ ID NO: 8816 - DNA, 71 bp, Homo sapiens
  chr6:170605686-170605757
  hyper
cgacggcgcacacctcggagccctgggggccggggtcggcgggcggggccggggcgcgccctttgtgcgct

SEQ ID NO: 8817 - DNA, 85 bp, Homo sapiens
  chr7:330501-330586
  hyper
cactttccccaacaccgcctcgctcctccgcctctgcgccccacggcgtcctgcgggatggggggaaggacggggggctgcccgg

SEQ ID NO: 8818 - DNA, 163 bp, Homo sapiens; identical to SEQ ID NO: 2953
  chr7:751986-752149
  hyper

SEQ ID NO: 8819 - DNA, 112 bp, Homo sapiens; identical to SEQ ID NO: 2954
  chr7:752150-752262
  hyper

SEQ ID NO: 8820 - DNA, 438 bp, Homo sapiens
  chr7:1263736-1264174
  hyper
ttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagaca

SEQ ID NO: 8821 - DNA, 149 bp, Homo sapiens
  chr7:1265323-1265472
  hyper
gcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttgg

SEQ ID NO: 8822 - DNA, 227 bp, Homo sapiens
  chr7:1269237-1269464
  hyper
ccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcc

SEQ ID NO: 8823 - DNA, 113 bp, Homo sapiens
  chr7:1270162-1270275
  hyper
aggaggttttcggagcgcgagccggcccgacagcatgaaaaacacagggcgattgaaatgcgagcattgggacgcacggagccgccgcggcgcggactcgctcttgaggtcaa

SEQ ID NO: 8824 - DNA, 334 bp, Homo sapiens
  chr7:1272630-1272964
  hyper
gccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcgg

SEQ ID NO: 8825 - DNA, 300 bp, Homo sapiens
  chr7:1274514-1274814
  hyper
aagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaag

SEQ ID NO: 8826 - DNA, 32 bp, Homo sapiens
  chr7:1275579-1275611
  hyper
acccggaggagatcgcgcgcaaggagctggag

SEQ ID NO: 8827 - DNA, 41 bp, Homo sapiens
  chr7:1276444-1276485
  hyper
cgcggacgcggggaccgccggccccgcgcccccgccgcccg

SEQ ID NO: 8828 - DNA, 124 bp, Homo sapiens
  chr7:1277174-1277298
  hyper
ctccccctcctaccccgcgccgcacacgcacgctcacatccgccgcgcgcccccgcgcgcactggcacacgccggggcgcgcggcgcggggtgacggagccgggggctgcgagggccgggccgc

SEQ ID NO: 8829 - DNA, 30 bp, Homo sapiens
  chr7:1280395-1280425
  hyper
aaattagccaggcctcgcagtctcctaatg

SEQ ID NO: 8830 - DNA, 37 bp, Homo sapiens
  chr7:1281142-1281179
  hyper
ccagcggctccctggcgcaccccggacacggtggcca

SEQ ID NO: 8831 - DNA, 37 bp, Homo sapiens
  chr7:1282107-1282144
  hyper
accacactcgggctgcggggagcgagcgcgggcgttg

SEQ ID NO: 8832 - DNA, 59 bp, Homo sapiens
  chr7:1282622-1282681
  hyper
gcccggccgggccctcgcgcgccggcttctgctgattctttctgcggcctgataataag

SEQ ID NO: 8833 - DNA, 94 bp, Homo sapiens
  chr7:1283626-1283720
  hyper
gacacaggggctttccgggatcgaaaggtgtttcttccctttctaagtcacgtcaggccacctccgaccccagccgacacgctaccaggcctgc

SEQ ID NO: 8834 - DNA, 27 bp, Homo sapiens
  chr7:1286084-1286111
  hyper
agggcgggcagaggccgggctgggagg

SEQ ID NO: 8835 - DNA, 135 bp, Homo sapiens
  chr7:1288552-1288687
  hyper
tctgagggagctttccgtgggatggctgggcctctgttgcagttgcgaccaatgctgcggtttaaattctccctgggtccaatcctgcttccctcccctaagcctctcgcacacacacctcggctcaggctattc

SEQ ID NO: 8836 - DNA, 122 bp, Homo sapiens
  chr7:1289414-1289536
  hyper
ggggcagcccccctccgcttcctcccacagctctatttagggcagacaggccaaagagagccacggaggcgtgttggacagcctagcagcggccatgaaccctggcacgtttatctgctgga

SEQ ID NO: 8837 - DNA, 124 bp, Homo sapiens; identical to SEQ ID NO: 2955
  chr7:1408647-1408771
  hyper

SEQ ID NO: 8838 - DNA, 34 bp, Homo sapiens; identical to SEQ ID NO: 2956
  chr7:1408874-1408908
  hyper

SEQ ID NO: 8839 - DNA, 603 bp, Homo sapiens
  chr7:1704139-1704742
  hyper
aggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacg

SEQ ID NO: 8840 - DNA, 91 bp, Homo sapiens
  chr7:1706301-1706392
  hyper
gtgcgctggggtagccgcggcgccccaagttgaaccacagacgaacccctcttcatctgaaacctggtctcggagtcggaggtggggaggg

SEQ ID NO: 8841 - DNA, 128 bp, Homo sapiens
  chr7:1707040-1707168
  hyper
ggcaggggggacccgcgaagctcctggagcgtttagggatgcagctcgggcggcgtgtgcagggaggaagcagcgtcccggcgtccccccttcagcgtcgccttcgcgcgcctcgagggcccaggagg

SEQ ID NO: 8842 - DNA, 351 bp, Homo sapiens
  chr7:1709093-1709444
  hyper
ccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgct

SEQ ID NO: 8843 - DNA, 21 bp, Homo sapiens
  chr7:1709902-1709923
  hyper
gaggaatttcaatcccgggag

SEQ ID NO: 8844 - DNA, 289 bp, Homo sapiens
  chr7:1709955-1710244
  hyper
cgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggt

SEQ ID NO: 8845 - DNA, 19 bp, Homo sapiens
  chr7:1710324-1710343
  hyper
cgtccgcaccctgcccggc

SEQ ID NO: 8846 - DNA, 39 bp, Homo sapiens
  chr7:2728085-2728124
  hyper
cggagacgcgaagggcgcacttggcgagggtttggtgca

SEQ ID NO: 8847 - DNA, 36 bp, Homo sapiens
  chr7:3083169-3083205
  hyper
ccccgacgccccccccgccaccgtgtcatctcactg

SEQ ID NO: 8848 - DNA, 361 bp, Homo sapiens
  chr7:3340254-3340615
  hyper
aaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtcccca

SEQ ID NO: 8849 - DNA, 30 bp, Homo sapiens
  chr7:3341956-3341986
  hyper
ccctccccagggcctcgtcctctccccagc

SEQ ID NO: 8850 - DNA, 67 bp, Homo sapiens
  chr7:4922640-4922707
  hyper
ggatgcagtatttgtcgaggggctggaaatggtacataaatagccgggaaacaatgctttgagctgg

SEQ ID NO: 8851 - DNA, 34 bp, Homo sapiens; identical to SEQ ID NO: 2957
  chr7:4923327-4923361
  hyper

SEQ ID NO: 8852 - DNA, 386 bp, Homo sapiens; identical to SEQ ID NO: 2958
  chr7:4998201-4998587
  hyper

SEQ ID NO: 8853 - DNA, 189 bp, Homo sapiens
  chr7:6566347-6566536
  hyper
cctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctgggggg

SEQ ID NO: 8854 - DNA, 244 bp, Homo sapiens
  chr7:6570454-6570698
  hyper
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctac

SEQ ID NO: 8855 - DNA, 244 bp, Homo sapiens
  chr7:6570933-6571177
  hyper
tgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagg

SEQ ID NO: 8856 - DNA, 297 bp, Homo sapiens
  chr7:6654798-6655095
  hyper
cgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagc

SEQ ID NO: 8857 - DNA, 110 bp, Homo sapiens
  chr7:6703598-6703708
  hyper
ggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 8858 - DNA, 94 bp, Homo sapiens
  chr7:6703709-6703803
  hyper
cgtccgaacagtcgcagccccgagcccctgggaccgccttccccgcggaggcttgggctcagcgcctggggcggaggtggggcgggggcggtcc

SEQ ID NO: 8859 - DNA, 66 bp, Homo sapiens
  chr7:6703804-6703870
  hyper
cccgcagcagggggtgccggggccgcctccgggtttcctccgctggatgcggcggtggtgcgctgt

SEQ ID NO: 8860 - DNA, 173 bp, Homo sapiens
  chr7:6703915-6704088
  hyper
cgccctgggccctcctccgaggtgcctcgcgtggggcccgtgccagggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 8861 - DNA, 154 bp, Homo sapiens; identical to SEQ ID NO: 2959
  chr7:8473139-8473293
  hyper

SEQ ID NO: 8862 - DNA, 607 bp, Homo sapiens; identical to SEQ ID NO: 629
  chr7:8473635-8474242
  hyper

SEQ ID NO: 8863 - DNA, 47 bp, Homo sapiens; identical to SEQ ID NO: 630
  chr7:8474515-8474562
  hyper

SEQ ID NO: 8864 - DNA, 140 bp, Homo sapiens
  chr7:8474957-8475097
  hyper
ctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcg

SEQ ID NO: 8865 - DNA, 54 bp, Homo sapiens
  chr7:8475348-8475402
  hyper
ggctgcgtgctggtacgtgcttttcctcctgcagcccaccgtctacttggtaag

SEQ ID NO: 8866 - DNA, 53 bp, Homo sapiens
  chr7:8476668-8476721
  hyper
tctttgcccctttatcgcctgaccgtagcagccgcggacgccagagggcgctg

SEQ ID NO: 8867 - DNA, 264 bp, Homo sapiens; identical to SEQ ID NO: 631
  chr7:8480763-8481027
  hyper

SEQ ID NO: 8868 - DNA, 61 bp, Homo sapiens; identical to SEQ ID NO: 2963
  chr7:8481642-8481703
  hyper

SEQ ID NO: 8869 - DNA, 282 bp, Homo sapiens; identical to SEQ ID NO: 2964
  chr7:8482016-8482298
  hyper

SEQ ID NO: 8870 - DNA, 156 bp, Homo sapiens; identical to SEQ ID NO: 2965
  chr7:8482669-8482825
  hyper

SEQ ID NO: 8871 - DNA, 139 bp, Homo sapiens; identical to SEQ ID NO: 2966
  chr7:8482884-8483023
  hyper

SEQ ID NO: 8872 - DNA, 596 bp, Homo sapiens; identical to SEQ ID NO: 632
  chr7:8483358-8483954
  hyper

SEQ ID NO: 8873 - DNA, 197 bp, Homo sapiens
  chr7:11871392-11871589
  hyper
cagatagagggtgggcgcctccgcctcgccctgcgccgcagccctgccggcgcccgggcgtagcagcagcagcaggagcagcggcagcggcagcggcagcggcagcagctgcaggacgccccggcgcggccccgcagcgccccggctcccggacgcccagcgcctggcttgcagccccatgccgcctgcagccactc

SEQ ID NO: 8874 - DNA, 98 bp, Homo sapiens
  chr7:12151205-12151303
  hyper
ctggggttctctctgcgcacgaaatccggggcgggcactatgtgattcgagcccgctgcgccctgggctcctcgtgtcgcccgcggggaaaggaggag

SEQ ID NO: 8875 - DNA, 30 bp, Homo sapiens
  chr7:12151622-12151652
  hyper
ggtcccctgcatgtccgcactcctgttctg

SEQ ID NO: 8876 - DNA, 32 bp, Homo sapiens
  chr7:12443294-12443326
  hyper
ggccaggaacatcagcgcgatcaccagcacgc

SEQ ID NO: 8877 - DNA, 30 bp, Homo sapiens
  chr7:15725085-15725115
  hyper
cgagccactcagagtcggcaacttgcaaga

SEQ ID NO: 8878 - DNA, 64 bp, Homo sapiens
  chr7:15725949-15726013
  hyper
agaggattgggagaacgggtgcaagccttgcgccgtggcgtgagggctgcgcaggcagccaaag

SEQ ID NO: 8879 - DNA, 350 bp, Homo sapiens
  chr7:15726686-15727036
  hyper
gaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggag

SEQ ID NO: 8880 - DNA, 30 bp, Homo sapiens
  chr7:15727290-15727320
  hyper
agaattcttacatttcgatagctcccaaaa

SEQ ID NO: 8881 - DNA, 82 bp, Homo sapiens
  chr7:18125980-18126062
  hyper
gggggcgcgagagggcgaggcagcggcctggcttctccccagcaccgttctctgtcacggccgccgcctgaccatcaccccg

SEQ ID NO: 8882 - DNA, 2 bp, Homo sapiens
  chr7:18126082-18126084
  hyper
cg

SEQ ID NO: 8883 - DNA, 94 bp, Homo sapiens
  chr7:18126664-18126758
  hyper
cggctggaggagcagcggcggcccccgagtcaactttcattccctttttgcttctgcctcaccattctcttctcctcctcgaaagatggctgtt

SEQ ID NO: 8884 - DNA, 37 bp, Homo sapiens; identical to SEQ ID NO: 633
  chr7:19145857-19145894
  hyper

SEQ ID NO: 8885 - DNA, 154 bp, Homo sapiens; identical to SEQ ID NO: 634
  chr7:19146031-19146185
  hyper

SEQ ID NO: 8886 - DNA, 345 bp, Homo sapiens; identical to SEQ ID NO: 635
  chr7:19146237-19146582
  hyper

SEQ ID NO: 8887 - DNA, 932 bp, Homo sapiens; identical to SEQ ID NO: 636
  chr7:19146942-19147874
  hyper

SEQ ID NO: 8888 - DNA, 8 bp, Homo sapiens
  chr7:19156125-19156133
  hyper
cggccttc

SEQ ID NO: 8889 - DNA, 340 bp, Homo sapiens; identical to SEQ ID NO: 638
  chr7:19156303-19156643
  hyper

SEQ ID NO: 8890 - DNA, 43 bp, Homo sapiens; identical to SEQ ID NO: 639
  chr7:19156703-19156746
  hyper

SEQ ID NO: 8891 - DNA, 138 bp, Homo sapiens; identical to SEQ ID NO: 640
  chr7:19157055-19157193
  hyper

SEQ ID NO: 8892 - DNA, 69 bp, Homo sapiens; identical to SEQ ID NO: 641
  chr7:19157194-19157263
  hyper

SEQ ID NO: 8893 - DNA, 303 bp, Homo sapiens; identical to SEQ ID NO: 642
  chr7:19157264-19157567
  hyper

SEQ ID NO: 8894 - DNA, 302 bp, Homo sapiens; identical to SEQ ID NO: 643
  chr7:19157633-19157935
  hyper

SEQ ID NO: 8895 - DNA, 30 bp, Homo sapiens
  chr7:19183647-19183677
  hyper
actttagatgcaaagcgtagatttgcactc

SEQ ID NO: 8896 - DNA, 268 bp, Homo sapiens; identical to SEQ ID NO: 2979
  chr7:19184148-19184416
  hyper

SEQ ID NO: 8897 - DNA, 32 bp, Homo sapiens
  chr7:19184803-19184835
  hyper
tccccctcttcaaaccgcgccatcctcctggg

SEQ ID NO: 8898 - DNA, 156 bp, Homo sapiens; identical to SEQ ID NO: 644
  chr7:20816291-20816447
  hyper

SEQ ID NO: 8899 - DNA, 30 bp, Homo sapiens
  chr7:20817170-20817200
  hyper
agtcacacttaattgcgccttctttatgat

SEQ ID NO: 8900 - DNA, 121 bp, Homo sapiens
  chr7:20817836-20817957
  hyper
cggtgcctttgtgtgcggtgggcgcggcgatgggctgctccggcccgcagcccgaggggagcggcgggcccgggccggggccagggctcgcggggagaccccagaccaccacctcactctt

SEQ ID NO: 8901 - DNA, 297 bp, Homo sapiens
  chr7:20817982-20818279
  hyper
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaa

SEQ ID NO: 8902 - DNA, 70 bp, Homo sapiens; identical to SEQ ID NO: 645
  chr7:20823261-20823331
  hyper

SEQ ID NO: 8903 - DNA, 497 bp, Homo sapiens; identical to SEQ ID NO: 646
  chr7:20823382-20823879
  hyper

SEQ ID NO: 8904 - DNA, 90 bp, Homo sapiens; identical to SEQ ID NO: 647
  chr7:20823919-20824009
  hyper

SEQ ID NO: 8905 - DNA, 275 bp, Homo sapiens; identical to SEQ ID NO: 2984
  chr7:20824475-20824750
  hyper

SEQ ID NO: 8906 - DNA, 49 bp, Homo sapiens
  chr7:20826611-20826660
  hyper
gcgccgtgaggtcatcggcgccgccgcctgccgccgtggtggaaggggg

SEQ ID NO: 8907 - DNA, 41 bp, Homo sapiens
  chr7:20827412-20827453
  hyper
ttatttttagggatgcgttgggacgtggatgcgcgcctgcg

SEQ ID NO: 8908 - DNA, 144 bp, Homo sapiens
  chr7:20830686-20830830
  hyper
gcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgag

SEQ ID NO: 8909 - DNA, 30 bp, Homo sapiens
  chr7:20833089-20833119
  hyper
tgctttagaatcattcgactctgagtccag

SEQ ID NO: 8910 - DNA, 30 bp, Homo sapiens
  chr7:20836099-20836129
  hyper
aagggcagctattaacgacagaaagttctt

SEQ ID NO: 8911 - DNA, 30 bp, Homo sapiens
  chr7:20836810-20836840
  hyper
ttgaaaggcctggcacgtcccagtctatat

SEQ ID NO: 8912 - DNA, 50 bp, Homo sapiens
  chr7:20838460-20838510
  hyper
aagggctagttaaaacgcagatggctgggctcgtccgcagagtttctgct

SEQ ID NO: 8913 - DNA, 30 bp, Homo sapiens
  chr7:21582593-21582623
  hyper
tcactccgcccccagcgggctggggcgggg

SEQ ID NO: 8914 - DNA, 74 bp, Homo sapiens
  chr7:21582834-21582908
  hyper
ggcctcgcgttccctcggacggttgcccaatggcagcccaggtggcagcccgggaggcgcgagacttcagagaa

SEQ ID NO: 8915 - DNA, 545 bp, Homo sapiens; identical to SEQ ID NO: 648
  chr7:22589325-22589870
  hyper

SEQ ID NO: 8916 - DNA, 98 bp, Homo sapiens; identical to SEQ ID NO: 2986
  chr7:23287253-23287351
  hyper

SEQ ID NO: 8917 - DNA, 92 bp, Homo sapiens; identical to SEQ ID NO: 2987
  chr7:23287532-23287624
  hyper

SEQ ID NO: 8918 - DNA, 476 bp, Homo sapiens
  chr7:23508261-23508737
  hyper
ccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtc

SEQ ID NO: 8919 - DNA, 220 bp, Homo sapiens
  chr7:23509018-23509238
  hyper
agggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcac

SEQ ID NO: 8920 - DNA, 30 bp, Homo sapiens
  chr7:23509641-23509671
  hyper
acaccgggatcttggcgtccttgaagatac

SEQ ID NO: 8921 - DNA, 406 bp, Homo sapiens
  chr7:23513721-23514127
  hyper
caccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctgg

SEQ ID NO: 8922 - DNA, 36 bp, Homo sapiens
  chr7:23514666-23514702
  hyper
actatgctgagaccacgttttcgttgaagctgccct

SEQ ID NO: 8923 - DNA, 84 bp, Homo sapiens
  chr7:24796506-24796590
  hyper
agggggacttttttccgtccagagagactgaactccgtatctgttccgcggtccgcctccctgcacacacgcccccgagccggg

SEQ ID NO: 8924 - DNA, 301 bp, Homo sapiens
  chr7:24797253-24797554
  hyper
tgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagt

SEQ ID NO: 8925 - DNA, 159 bp, Homo sapiens; identical to SEQ ID NO: 649
  chr7:25896441-25896600
  hyper

SEQ ID NO: 8926 - DNA, 278 bp, Homo sapiens; identical to SEQ ID NO: 650
  chr7:25896660-25896938
  hyper

SEQ ID NO: 8927 - DNA, 30 bp, Homo sapiens
  chr7:25902574-25902604
  hyper
ttggttcttacaagtcgttaagagttgtaa

SEQ ID NO: 8928 - DNA, 281 bp, Homo sapiens
  chr7:26415803-26416084
  hyper
cccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctg

SEQ ID NO: 8929 - DNA, 505 bp, Homo sapiens; identical to SEQ ID NO: 651
  chr7:27135266-27135771
  hyper

SEQ ID NO: 8930 - DNA, 445 bp, Homo sapiens; identical to SEQ ID NO: 652
  chr7:27135979-27136424
  hyper

SEQ ID NO: 8931 - DNA, 324 bp, Homo sapiens; identical to SEQ ID NO: 653
  chr7:27136425-27136749
  hyper

SEQ ID NO: 8932 - DNA, 699 bp, Homo sapiens; identical to SEQ ID NO: 654
  chr7:27190372-27191071
  hyper

SEQ ID NO: 8933 - DNA, 16 bp, Homo sapiens
  chr7:27195586-27195602
  hyper
atgctatgggctccac

SEQ ID NO: 8934 - DNA, 27 bp, Homo sapiens
  chr7:27195866-27195893
  hyper
cgcctttggcgaggtcactgcagagcc

SEQ ID NO: 8935 - DNA, 1 bp, Homo sapiens
  chr7:27196152-27196153
  hyper
c

SEQ ID NO: 8936 - DNA, 132 bp, Homo sapiens; identical to SEQ ID NO: 658
  chr7:27196154-27196286
  hyper

SEQ ID NO: 8937 - DNA, 351 bp, Homo sapiens; identical to SEQ ID NO: 659
  chr7:27196287-27196638
  hyper

SEQ ID NO: 8938 - DNA, 354 bp, Homo sapiens
  chr7:27204416-27204770
  hyper
tcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 8939 - DNA, 99 bp, Homo sapiens
  chr7:27205265-27205364
  hyper
cgctattaatggtccgatgttttgcagtcataatttttatagcaaaagccatatgtttttatgtaaagggatcgtgccgctctacgatggggtttgttt

SEQ ID NO: 8940 - DNA, 84 bp, Homo sapiens
  chr7:27205706-27205790
  hyper
agctgtaaaaatttacgaggacttggaaaggttagactgttgtgtttggttggcgagctccctgtaaataatccctgcggtccc

SEQ ID NO: 8941 - DNA, 80 bp, Homo sapiens
  chr7:27209584-27209664
  hyper
ctccctgtctggccccggcctcccgcctctcgctctccccctctccctcctagctgcccgcccgccggggcgcgcgctcc

SEQ ID NO: 8942 - DNA, 324 bp, Homo sapiens; identical to SEQ ID NO: 660
  chr7:27212660-27212984
  hyper

SEQ ID NO: 8943 - DNA, 796 bp, Homo sapiens; identical to SEQ ID NO: 661
  chr7:27213188-27213984
  hyper

SEQ ID NO: 8944 - DNA, 277 bp, Homo sapiens; identical to SEQ ID NO: 662
  chr7:27213985-27214262
  hyper

SEQ ID NO: 8945 - DNA, 448 bp, Homo sapiens
  chr7:27219396-27219844
  hyper
tgttatgaaggggagcgggacaagtgaaataatgtaccgtgctgctcttagtatcagaagcgaacaaaggccaagaatcatgctggggttcccggctccccggcggctttgacattgatcggaagtgcgccatctcgtggcggctgcgcgcctaggttgggccggagttccagccccgagccgagagacggaaaccagctccgggcagagagagaaggagagaggagaggatgtgcccagcccgctgctattgagatctcatttttacatctaagaaatcgctgcaaaaccccagccgggtttatagcggcgcattccaaatatgcaaattggccggccccggacgggtttacgaccacattgtcacagccatcggaggatgggcttttatagggctcagaaatcaaacccgcgcccgcccgccgcccgcccgcgagcagtcctcctg

SEQ ID NO: 8946 - DNA, 27 bp, Homo sapiens
  chr7:27223166-27223193
  hyper
cagcttctgcctccccggccagccttc

SEQ ID NO: 8947 - DNA, 59 bp, Homo sapiens
  chr7:27223221-27223280
  hyper
cggaagccccctaccctaggccttcgctgagcaccacggccacacggccatcctgcaca

SEQ ID NO: 8948 - DNA, 159 bp, Homo sapiens
  chr7:27223601-27223760
  hyper
gccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctg

SEQ ID NO: 8949 - DNA, 633 bp, Homo sapiens; identical to SEQ ID NO: 3002
  chr7:27223976-27224609
  hyper

SEQ ID NO: 8950 - DNA, 4 bp, Homo sapiens
  chr7:27225054-27225058
  hyper
actc

SEQ ID NO: 8951 - DNA, 680 bp, Homo sapiens; identical to SEQ ID NO: 3003
  chr7:27232300-27232980
  hyper

SEQ ID NO: 8952 - DNA, 32 bp, Homo sapiens
  chr7:27239141-27239173
  hyper
gcccatgcgggcgcacgggtagtagccgctgc

SEQ ID NO: 8953 - DNA, 223 bp, Homo sapiens
  chr7:27239225-27239448
  hyper
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggcc

SEQ ID NO: 8954 - DNA, 162 bp, Homo sapiens
  chr7:27239668-27239830
  hyper
gggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccg

SEQ ID NO: 8955 - DNA, 35 bp, Homo sapiens
  chr7:27240230-27240265
  hyper
tttctttccaggaaccggcgcgtatttctgcagtg

SEQ ID NO: 8956 - DNA, 30 bp, Homo sapiens
  chr7:27240997-27241027
  hyper
aaccaagcagcgacccgtcttgtagctgcc

SEQ ID NO: 8957 - DNA, 72 bp, Homo sapiens
  chr7:27244539-27244611
  hyper
actcctcagagctggcgcaaactccgtcctccaaaactcggctctgggaggcctaagtgactccgaagccgg

SEQ ID NO: 8958 - DNA, 378 bp, Homo sapiens; identical to SEQ ID NO: 663
  chr7:27244932-27245310
  hyper

SEQ ID NO: 8959 - DNA, 24 bp, Homo sapiens
  chr7:27252795-27252819
  hyper
tttttctttctctcccggattgtt

SEQ ID NO: 8960 - DNA, 270 bp, Homo sapiens
  chr7:27252895-27253165
  hyper
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggccc

SEQ ID NO: 8961 - DNA, 437 bp, Homo sapiens; identical to SEQ ID NO: 664
  chr7:27264875-27265312
  hyper

SEQ ID NO: 8962 - DNA, 46 bp, Homo sapiens; identical to SEQ ID NO: 3006
  chr7:27265538-27265584
  hyper

SEQ ID NO: 8963 - DNA, 132 bp, Homo sapiens; identical to SEQ ID NO: 665
  chr7:27279237-27279369
  hyper

SEQ ID NO: 8964 - DNA, 18 bp, Homo sapiens
  chr7:27279453-27279471
  hyper
cgccgggcctggagcggc

SEQ ID NO: 8965 - DNA, 200 bp, Homo sapiens
  chr7:27282262-27282462
  hyper
ccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtga

SEQ ID NO: 8966 - DNA, 549 bp, Homo sapiens
  chr7:27282746-27283295
  hyper
gcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 8967 - DNA, 118 bp, Homo sapiens; identical to SEQ ID NO: 3009
  chr7:27285707-27285825
  hyper

SEQ ID NO: 8968 - DNA, 30 bp, Homo sapiens
  chr7:27289482-27289512
  hyper
ggcatgccccacgaacggtttctttagtga

SEQ ID NO: 8969 - DNA, 44 bp, Homo sapiens
  chr7:27289813-27289857
  hyper
cagccaccatatgtccgccggagaataagcgtgagtgtcgcggt

SEQ ID NO: 8970 - DNA, 173 bp, Homo sapiens; identical to SEQ ID NO: 667
  chr7:27290946-27291119
  hyper

SEQ ID NO: 8971 - DNA, 537 bp, Homo sapiens; identical to SEQ ID NO: 668
  chr7:27291314-27291851
  hyper

SEQ ID NO: 8972 - DNA, 38 bp, Homo sapiens; identical to SEQ ID NO: 3012
  chr7:28449253-28449291
  hyper

SEQ ID NO: 8973 - DNA, 124 bp, Homo sapiens; identical to SEQ ID NO: 3013
  chr7:28449658-28449782
  hyper

SEQ ID NO: 8974 - DNA, 184 bp, Homo sapiens; identical to SEQ ID NO: 3014
  chr7:28449857-28450041
  hyper

SEQ ID NO: 8975 - DNA, 33 bp, Homo sapiens
  chr7:28995925-28995958
  hyper
tgggtcggacaccagcggcggcagcccggcccc

SEQ ID NO: 8976 - DNA, 256 bp, Homo sapiens
  chr7:28996623-28996879
  hyper
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcc

SEQ ID NO: 8977 - DNA, 239 bp, Homo sapiens
  chr7:28997128-28997367
  hyper
caagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggt

SEQ ID NO: 8978 - DNA, 62 bp, Homo sapiens
  chr7:28997584-28997646
  hyper
acacgggctcggcagcggcgggagcgcgaggcagccgcacaccacgagcaggaggcgcaagg

SEQ ID NO: 8979 - DNA, 479 bp, Homo sapiens
  chr7:28997676-28998155
  hyper
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcg

SEQ ID NO: 8980 - DNA, 332 bp, Homo sapiens; identical to SEQ ID NO: 3015
  chr7:29185865-29186197
  hyper

SEQ ID NO: 8981 - DNA, 43 bp, Homo sapiens
  chr7:29604285-29604328
  hyper
aatgacttgggggtacgggttgcttttccgatctgcaaagtag

SEQ ID NO: 8982 - DNA, 95 bp, Homo sapiens
  chr7:29846202-29846297
  hyper
ctgcgggacggagcccggagccggaggcggcggcggcggagacgtcggccggagctcgagtccagtccagcccccggctccgccacctgcaggta

SEQ ID NO: 8983 - DNA, 476 bp, Homo sapiens; identical to SEQ ID NO: 669
  chr7:30721202-30721678
  hyper

SEQ ID NO: 8984 - DNA, 88 bp, Homo sapiens
  chr7:30722026-30722114
  hyper
cgggcagcctttgggcgccacctccggtcgcccagagctgtcaagtggggaccttcccggagaggagccgccgagtgcacggagctgc

SEQ ID NO: 8985 - DNA, 260 bp, Homo sapiens
  chr7:30722115-30722375
  hyper
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgc

SEQ ID NO: 8986 - DNA, 39 bp, Homo sapiens
  chr7:31092310-31092349
  hyper
gcggctgcccctccacgcctcggccgtcttctccccctc

SEQ ID NO: 8987 - DNA, 15 bp, Homo sapiens
  chr7:31092684-31092699
  hyper
ctacccttaggtgga

SEQ ID NO: 8988 - DNA, 167 bp, Homo sapiens
  chr7:31092713-31092880
  hyper
cggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtctt

SEQ ID NO: 8989 - DNA, 296 bp, Homo sapiens
  chr7:31092894-31093190
  hyper
cggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcgggaccttggcaggttagggggctcagaagggacaggggagccgatggatgcaactagaccctcaggagggaacccagccggaagccgattgcatttcacgtggagctgaggag

SEQ ID NO: 8990 - DNA, 39 bp, Homo sapiens
  chr7:32110353-32110392
  hyper
acaaagccacagaagcgatcagcgcgcagctaaagggtt

SEQ ID NO: 8991 - DNA, 89 bp, Homo sapiens; identical to SEQ ID NO: 3017
  chr7:32110706-32110795
  hyper

SEQ ID NO: 8992 - DNA, 73 bp, Homo sapiens; identical to SEQ ID NO: 3018
  chr7:32338145-32338218
  hyper

SEQ ID NO: 8993 - DNA, 305 bp, Homo sapiens; identical to SEQ ID NO: 3019
  chr7:32338283-32338588
  hyper

SEQ ID NO: 8994 - DNA, 90 bp, Homo sapiens
  chr7:32338925-32339015
  hyper
tccaaacaaggaagtcgggaaaatcgccacgcccacttccttctagccactgcccccagcactggcctggagccccgatagtgtttcttc

SEQ ID NO: 8995 - DNA, 237 bp, Homo sapiens; identical to SEQ ID NO: 670
  chr7:32467419-32467656
  hyper

SEQ ID NO: 8996 - DNA, 69 bp, Homo sapiens; identical to SEQ ID NO: 671
  chr7:32467946-32468015
  hyper

SEQ ID NO: 8997 - DNA, 30 bp, Homo sapiens
  chr7:32468472-32468502
  hyper
gtgtggtggtgcctacgtagagcagaagca

SEQ ID NO: 8998 - DNA, 266 bp, Homo sapiens; identical to SEQ ID NO: 672
  chr7:33943692-33943958
  hyper

SEQ ID NO: 8999 - DNA, 123 bp, Homo sapiens
  chr7:33944250-33944373
  hyper
acttgcccctctgtccgctcagccccctgagttcgctgtcgcgcccccgccagagggaagcaaagcagggcatgaaaagttgcgggggccctactgccccgggtgtgtcgctccttcccaaag

SEQ ID NO: 9000 - DNA, 81 bp, Homo sapiens
  chr7:33944751-33944832
  hyper
aggaggtgaggagtgcgggagtggaggacgctgcggcagcgacagcgacagcccccgaaacagtagcggcagcccgggcgg

SEQ ID NO: 9001 - DNA, 66 bp, Homo sapiens
  chr7:33945406-33945472
  hyper
acctgggaaaggtggcgctggcttgccccggggatgggagggtggggagcgcgcaccttggcgctt

SEQ ID NO: 9002 - DNA, 554 bp, Homo sapiens; identical to SEQ ID NO: 3023
  chr7:35225280-35225834
  hyper

SEQ ID NO: 9003 - DNA, 420 bp, Homo sapiens; identical to SEQ ID NO: 3024
  chr7:35226044-35226464
  hyper

SEQ ID NO: 9004 - DNA, 296 bp, Homo sapiens; identical to SEQ ID NO: 673
  chr7:35293182-35293478
  hyper

SEQ ID NO: 9005 - DNA, 110 bp, Homo sapiens; identical to SEQ ID NO: 674
  chr7:35294031-35294141
  hyper

SEQ ID NO: 9006 - DNA, 73 bp, Homo sapiens; identical to SEQ ID NO: 3027
  chr7:35294502-35294575
  hyper

SEQ ID NO: 9007 - DNA, 53 bp, Homo sapiens; identical to SEQ ID NO: 675
  chr7:35296952-35297005
  hyper

SEQ ID NO: 9008 - DNA, 217 bp, Homo sapiens; identical to SEQ ID NO: 676
  chr7:35297137-35297354
  hyper

SEQ ID NO: 9009 - DNA, 547 bp, Homo sapiens; identical to SEQ ID NO: 677
  chr7:35297470-35298017
  hyper

SEQ ID NO: 9010 - DNA, 58 bp, Homo sapiens
  chr7:35300951-35301009
  hyper
ctttcacttggcctgcgctcaggtcagtgcgccccttaccggagcacccatggcctcc

SEQ ID NO: 9011 - DNA, 500 bp, Homo sapiens; identical to SEQ ID NO: 678
  chr7:35301244-35301744
  hyper

SEQ ID NO: 9012 - DNA, 147 bp, Homo sapiens; identical to SEQ ID NO: 679
  chr7:37487113-37487260
  hyper

SEQ ID NO: 9013 - DNA, 74 bp, Homo sapiens; identical to SEQ ID NO: 680
  chr7:37487380-37487454
  hyper

SEQ ID NO: 9014 - DNA, 71 bp, Homo sapiens; identical to SEQ ID NO: 681
  chr7:37487755-37487826
  hyper

SEQ ID NO: 9015 - DNA, 878 bp, Homo sapiens; identical to SEQ ID NO: 3035
  chr7:37488141-37489019
  hyper

SEQ ID NO: 9016 - DNA, 234 bp, Homo sapiens
  chr7:37955745-37955979
  hyper
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatgg

SEQ ID NO: 9017 - DNA, 222 bp, Homo sapiens
  chr7:37956271-37956493
  hyper
cagtcggcagcaaagcggggccgcggggtccggccgcggagctccgccgtctggcacacagggcacgagcagcgccagctctcagccttcggggcgcgaacccgcccgggcagctccagtcccggactccgcagctcggagcgcagccagccacggccattgcgggaccctatttatcccgacacctcccctgacgtgggctcggaacgctcccttggcagc

SEQ ID NO: 9018 - DNA, 72 bp, Homo sapiens
  chr7:37960465-37960537
  hyper
gagccactctgatcccggacgcctcagcgcccccttgggcttgggcttgccctcgggccggggaaggctgac

SEQ ID NO: 9019 - DNA, 396 bp, Homo sapiens
  chr7:37960562-37960958
  hyper
cgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagaggtacaggtcatcggcccgcggggcgggagtagggagccgcgcgggcatggggagggcgaggtcgcagaggcctgcgccctgtaactctttccggccccttgcagctcctcccttctcccagagagatctttcgcgaggagggtctctt

SEQ ID NO: 9020 - DNA, 268 bp, Homo sapiens; identical to SEQ ID NO: 682
  chr7:38670396-38670664
  hyper

SEQ ID NO: 9021 - DNA, 44 bp, Homo sapiens
  chr7:38671120-38671164
  hyper
gggaccagcttaaagcgacagagcgggggcgggatgcgtcggga

SEQ ID NO: 9022 - DNA, 269 bp, Homo sapiens
  chr7:39015574-39015843
  hyper
ctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttc

SEQ ID NO: 9023 - DNA, 64 bp, Homo sapiens
  chr7:39453541-39453605
  hyper
aagatgccccacaaacgacggtcccctggtccgaggagccgggcagcgccgcgcagccgtctcg

SEQ ID NO: 9024 - DNA, 30 bp, Homo sapiens
  chr7:39454074-39454104
  hyper
cggaagtgccctcgccgtcctgaggcctgg

SEQ ID NO: 9025 - DNA, 52 bp, Homo sapiens
  chr7:42267660-42267712
  hyper
cccgaggtcccaggccgcggcggcggcgcggtgggttcattagcgggcgcgc

SEQ ID NO: 9026 - DNA, 42 bp, Homo sapiens
  chr7:42275797-42275839
  hyper
ctctctgccttctcccgcccgttttcccgctgctactcaaga

SEQ ID NO: 9027 - DNA, 50 bp, Homo sapiens
  chr7:42276128-42276178
  hyper
cctcccgcctccttccgcccatcccgagcgccgtgcgcgcccgaagcccg

SEQ ID NO: 9028 - DNA, 338 bp, Homo sapiens
  chr7:42276557-42276895
  hyper
agcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 9029 - DNA, 47 bp, Homo sapiens
  chr7:42277420-42277467
  hyper
cccgcttctcccgcccgccgggtccccaagcccggagtgggtcccag

SEQ ID NO: 9030 - DNA, 73 bp, Homo sapiens
  chr7:42277748-42277821
  hyper
gaggggaagggggcccgggcgtgatgtcacccgcgccctctctcttctctctccacaccgccaggacaccccc

SEQ ID NO: 9031 - DNA, 15 bp, Homo sapiens
  chr7:43152193-43152208
  hyper
gggaggggatgcaag

SEQ ID NO: 9032 - DNA, 502 bp, Homo sapiens; identical to SEQ ID NO: 3038
  chr7:43152413-43152915
  hyper

SEQ ID NO: 9033 - DNA, 252 bp, Homo sapiens
  chr7:43153229-43153481
  hyper
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtctt

SEQ ID NO: 9034 - DNA, 41 bp, Homo sapiens
  chr7:44144029-44144070
  hyper
cgaccacccctgagcccctctggcttcggagccccccagca

SEQ ID NO: 9035 - DNA, 346 bp, Homo sapiens
  chr7:44364736-44365082
  hyper
agagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 9036 - DNA, 66 bp, Homo sapiens
  chr7:44365117-44365183
  hyper
cgggagacacctcggctcgcggcgccaggcgggggccgggctgggctgcgccgggcggcgagcgca

SEQ ID NO: 9037 - DNA, 279 bp, Homo sapiens; identical to SEQ ID NO: 3039
  chr7:45613535-45613814
  hyper

SEQ ID NO: 9038 - DNA, 880 bp, Homo sapiens; identical to SEQ ID NO: 3040
  chr7:45613857-45614737
  hyper

SEQ ID NO: 9039 - DNA, 87 bp, Homo sapiens
  chr7:45928490-45928577
  hyper
gggactcagttgccgcgcgctgccgggggagcagcaacctctgcacgccctcacccgcggccaaggcgcctgcgtgcaggagtctga

SEQ ID NO: 9040 - DNA, 373 bp, Homo sapiens
  chr7:45960743-45961116
  hyper
cctgcaaccggggcacgctgcttggcaggctgggcgcgcagggatggggcgacagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaacca

SEQ ID NO: 9041 - DNA, 30 bp, Homo sapiens
  chr7:45961508-45961538
  hyper
gcaagaagactctcacgtgttgctacaccg

SEQ ID NO: 9042 - DNA, 179 bp, Homo sapiens
  chr7:45961778-45961957
  hyper
gtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagag

SEQ ID NO: 9043 - DNA, 713 bp, Homo sapiens
  chr7:48074975-48075688
  hyper
ttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccc

SEQ ID NO: 9044 - DNA, 198 bp, Homo sapiens; identical to SEQ ID NO: 683
  chr7:49812820-49813018
  hyper

SEQ ID NO: 9045 - DNA, 197 bp, Homo sapiens; identical to SEQ ID NO: 684
  chr7:49813809-49814006
  hyper

SEQ ID NO: 9046 - DNA, 78 bp, Homo sapiens
  chr7:49814581-49814659
  hyper
tgggtgcctgaattacgtggttcaaggcagagctttgcaggggggcgcgggcctggctcgctgcgttccctgggctcc

SEQ ID NO: 9047 - DNA, 134 bp, Homo sapiens; identical to SEQ ID NO: 685
  chr7:49815116-49815250
  hyper

SEQ ID NO: 9048 - DNA, 109 bp, Homo sapiens; identical to SEQ ID NO: 686
  chr7:49815656-49815765
  hyper

SEQ ID NO: 9049 - DNA, 256 bp, Homo sapiens; identical to SEQ ID NO: 3045
  chr7:50343234-50343490
  hyper

SEQ ID NO: 9050 - DNA, 320 bp, Homo sapiens; identical to SEQ ID NO: 3046
  chr7:50343974-50344294
  hyper

SEQ ID NO: 9051 - DNA, 36 bp, Homo sapiens; identical to SEQ ID NO: 3047
  chr7:50344295-50344331
  hyper

SEQ ID NO: 9052 - DNA, 406 bp, Homo sapiens; identical to SEQ ID NO: 3048
  chr7:50344332-50344738
  hyper

SEQ ID NO: 9053 - DNA, 289 bp, Homo sapiens; identical to SEQ ID NO: 3049
  chr7:54612441-54612730
  hyper

SEQ ID NO: 9054 - DNA, 71 bp, Homo sapiens
  chr7:54614037-54614108
  hyper
gaggggaagggggtccgggcgagggagacctagttgagcgagaggcggcgcccctgcgagccagcaagaga

SEQ ID NO: 9055 - DNA, 72 bp, Homo sapiens
  chr7:54732296-54732368
  hyper
atgacgctgaccggccggtgatgaggaagccaccaagggaagcaattagacacaggacgtgctggacctgca

SEQ ID NO: 9056 - DNA, 49 bp, Homo sapiens
  chr7:64349041-64349090
  hyper
cgcgtcttcggcaaagtcttcggggtgagaggtccggctcctggaggac

SEQ ID NO: 9057 - DNA, 37 bp, Homo sapiens
  chr7:64407804-64407841
  hyper
caggcaagccagttccggaccgcgtggcaccaggagc

SEQ ID NO: 9058 - DNA, 282 bp, Homo sapiens
  chr7:64700367-64700649
  hyper
ccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccg

SEQ ID NO: 9059 - DNA, 262 bp, Homo sapiens
  chr7:64712422-64712684
  hyper
cgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgt

SEQ ID NO: 9060 - DNA, 215 bp, Homo sapiens
  chr7:64734490-64734705
  hyper
gaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccaga

SEQ ID NO: 9061 - DNA, 180 bp, Homo sapiens; identical to SEQ ID NO: 3050
  chr7:64974270-64974450
  hyper

SEQ ID NO: 9062 - DNA, 480 bp, Homo sapiens; identical to SEQ ID NO: 3051
  chr7:64974510-64974990
  hyper

SEQ ID NO: 9063 - DNA, 77 bp, Homo sapiens
  chr7:65037634-65037711
  hyper
gaaaagccgcggcagcggggggccaaaagccggacgggcagaaagccgtggcagcggcgggcaaaaagccgcggcgg

SEQ ID NO: 9064 - DNA, 56 bp, Homo sapiens
  chr7:65446028-65446084
  hyper
ccttctcccgatccccgggcccagctctgtgcagtgcatgccgctgtggccagagt

SEQ ID NO: 9065 - DNA, 35 bp, Homo sapiens
  chr7:65508965-65509000
  hyper
cagcctgctaagtcccgggtcggataccaggctgg

SEQ ID NO: 9066 - DNA, 593 bp, Homo sapiens
  chr7:69062375-69062968
  hyper
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcc

SEQ ID NO: 9067 - DNA, 286 bp, Homo sapiens
  chr7:69064841-69065127
  hyper
cccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcag

SEQ ID NO: 9068 - DNA, 30 bp, Homo sapiens
  chr7:70596147-70596177
  hyper
atttgaacagagcagcgggtgggcctagaa

SEQ ID NO: 9069 - DNA, 235 bp, Homo sapiens; identical to SEQ ID NO: 3052
  chr7:70596453-70596688
  hyper

SEQ ID NO: 9070 - DNA, 140 bp, Homo sapiens
  chr7:70598169-70598309
  hyper
cgtttcgggcagatggccggggctgctggaaagaacaacttgcctgattcttttctgtgccccacctgcaaatttggttttatcctggaaacatgtcagtacagttggctcccggtccccgcgtgcggactggaaatcat

SEQ ID NO: 9071 - DNA, 111 bp, Homo sapiens
  chr7:71217046-71217157
  hyper
aacgtttcgcagcaccgggtccaaggaagtgcaatacaacagcaaaatgcaatggccgcagcagctcagtgatgggccgagactcgtcccgtgtggcggagatgctggcat

SEQ ID NO: 9072 - DNA, 126 bp, Homo sapiens; identical to SEQ ID NO: 3053
  chr7:71800631-71800757
  hyper

SEQ ID NO: 9073 - DNA, 40 bp, Homo sapiens; identical to SEQ ID NO: 3054
  chr7:71800933-71800973
  hyper

SEQ ID NO: 9074 - DNA, 72 bp, Homo sapiens; identical to SEQ ID NO: 687
  chr7:71802451-71802523
  hyper

SEQ ID NO: 9075 - DNA, 95 bp, Homo sapiens; identical to SEQ ID NO: 688
  chr7:71802577-71802672
  hyper

SEQ ID NO: 9076 - DNA, 138 bp, Homo sapiens
  chr7:76145381-76145519
  hyper
atctgtgcacaaggccggtggttcccgtcgtcgccactcggggtcgccggtgagccgcagccaggccgcctcacggccagtgtgcatgctcgctgctattcgctgccccttctgcctccgaggcggtagcagatgcca

SEQ ID NO: 9077 - DNA, 46 bp, Homo sapiens
  chr7:79081775-79081821
  hyper
gtcccttcttttcttcgccagcggtggctcacggatccctaaggga

SEQ ID NO: 9078 - DNA, 59 bp, Homo sapiens
  chr7:79082159-79082218
  hyper
ctttagcccccaagtcgaatccccggcgaaactcacttgcactgcgggtgctctctggc

SEQ ID NO: 9079 - DNA, 644 bp, Homo sapiens; identical to SEQ ID NO: 689
  chr7:79083190-79083834
  hyper

SEQ ID NO: 9080 - DNA, 158 bp, Homo sapiens
  chr7:82072350-82072508
  hyper
cttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccag

SEQ ID NO: 9081 - DNA, 45 bp, Homo sapiens
  chr7:83278225-83278270
  hyper
acaaaaccgagcacacgcactcccttctcccgtggaggtcctctc

SEQ ID NO: 9082 - DNA, 46 bp, Homo sapiens
  chr7:84814651-84814697
  hyper
tgcgcgcccccaccccgccatcccccgctagcgcacacatgcagga

SEQ ID NO: 9083 - DNA, 102 bp, Homo sapiens
  chr7:84815744-84815846
  hyper
ggcggggtgggactgcgccccaggggccgcgctgaagctggcgccgcgattactgcgcaccgatttcgcccactctctgtccgctcccgggagccttctctg

SEQ ID NO: 9084 - DNA, 71 bp, Homo sapiens
  chr7:84816281-84816352
  hyper
tggcgaggaaaggcacgctccaaacaggagggcggcttttaagtttgtggtgtgaccgcagcagctgtcct

SEQ ID NO: 9085 - DNA, 510 bp, Homo sapiens; identical to SEQ ID NO: 3058
  chr7:86273208-86273718
  hyper

SEQ ID NO: 9086 - DNA, 13 bp, Homo sapiens
  chr7:86273719-86273732
  hyper
gcttcagcctggt

SEQ ID NO: 9087 - DNA, 109 bp, Homo sapiens
  chr7:87104813-87104922
  hyper
caagtacaccctctccggcggcccggcgcacgagtcgcggggcccgggggcactgggtggaggtccggccactcccgccccgcgccccacgtcccgggtctcccttcga

SEQ ID NO: 9088 - DNA, 335 bp, Homo sapiens; identical to SEQ ID NO: 690
  chr7:87229568-87229903
  hyper

SEQ ID NO: 9089 - DNA, 131 bp, Homo sapiens; identical to SEQ ID NO: 3061
  chr7:87230213-87230344
  hyper

SEQ ID NO: 9090 - DNA, 178 bp, Homo sapiens; identical to SEQ ID NO: 3062
  chr7:87230345-87230523
  hyper

SEQ ID NO: 9091 - DNA, 148 bp, Homo sapiens
  chr7:87257340-87257488
  hyper
gtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatcc

SEQ ID NO: 9092 - DNA, 41 bp, Homo sapiens
  chr7:87258357-87258398
  hyper
gccgcccagtgcccccgcctatgttgcgccagccaaatctg

SEQ ID NO: 9093 - DNA, 57 bp, Homo sapiens
  chr7:87936127-87936184
  hyper
ggaggaagcgtccagcgccaacggtgcgcgccgcgggccgggcgggtagagggaagt

SEQ ID NO: 9094 - DNA, 40 bp, Homo sapiens; identical to SEQ ID NO: 3063
  chr7:88388606-88388646
  hyper

SEQ ID NO: 9095 - DNA, 255 bp, Homo sapiens; identical to SEQ ID NO: 3064
  chr7:88388647-88388902
  hyper

SEQ ID NO: 9096 - DNA, 207 bp, Homo sapiens; identical to SEQ ID NO: 3065
  chr7:88389046-88389253
  hyper

SEQ ID NO: 9097 - DNA, 101 bp, Homo sapiens
  chr7:89748330-89748431
  hyper
tgggggtgctgcaggcgctggggagagtgtggagaggctgcgtggagctgcgcgctcggggtgggggctgcactcccaatgaagcgcgtgaagggcaagcg

SEQ ID NO: 9098 - DNA, 467 bp, Homo sapiens; identical to SEQ ID NO: 3066
  chr7:89950183-89950650
  hyper

SEQ ID NO: 9099 - DNA, 16 bp, Homo sapiens
  chr7:90226268-90226284
  hyper
ggttctcccctcctcc

SEQ ID NO: 9100 - DNA, 264 bp, Homo sapiens
  chr7:90226285-90226549
  hyper
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagc

SEQ ID NO: 9101 - DNA, 329 bp, Homo sapiens
  chr7:91808202-91808531
  hyper
ttcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggc

SEQ ID NO: 9102 - DNA, 34 bp, Homo sapiens
  chr7:93203722-93203756
  hyper
ccgcagggtgaggtgcggacgtgcgcacttctcc

SEQ ID NO: 9103 - DNA, 130 bp, Homo sapiens
  chr7:93204298-93204428
  hyper
cgctccagtcagggctggggctcaccctgcgagtccgggagactaaagcgccgcgtaaacacaggaagcaggcgagggacccgagttagaccttgagtagggagggagaggggggcgacagtctggactg

SEQ ID NO: 9104 - DNA, 309 bp, Homo sapiens
  chr7:93519457-93519766
  hyper
tccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggag

SEQ ID NO: 9105 - DNA, 170 bp, Homo sapiens
  chr7:93519854-93520024
  hyper
cgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggc

SEQ ID NO: 9106 - DNA, 112 bp, Homo sapiens
  chr7:93520025-93520137
  hyper
tccgagaaagcgcctggcgggaggaggtgcgcggctttctgctccaggcggcccgggtgcccgctttatgcggggcgagcgtccggccgacccccgccggggcggagcctga

SEQ ID NO: 9107 - DNA, 421 bp, Homo sapiens
  chr7:93551060-93551481
  hyper
agcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccaga

SEQ ID NO: 9108 - DNA, 402 bp, Homo sapiens; identical to SEQ ID NO: 3067
  chr7:94284694-94285096
  hyper

SEQ ID NO: 9109 - DNA, 61 bp, Homo sapiens
  chr7:94536939-94537000
  hyper
tctctctccctctcccgggattttgctgccgggctccctctctctgcggccctagagttaa

SEQ ID NO: 9110 - DNA, 96 bp, Homo sapiens; identical to SEQ ID NO: 691
  chr7:96621715-96621811
  hyper

SEQ ID NO: 9111 - DNA, 180 bp, Homo sapiens; identical to SEQ ID NO: 3069
  chr7:96622169-96622349
  hyper

SEQ ID NO: 9112 - DNA, 30 bp, Homo sapiens
  chr7:96625690-96625720
  hyper
gcactggtgtgaattcgctttgaaactcaa

SEQ ID NO: 9113 - DNA, 112 bp, Homo sapiens; identical to SEQ ID NO: 3070
  chr7:96625974-96626086
  hyper

SEQ ID NO: 9114 - DNA, 118 bp, Homo sapiens
  chr7:96627308-96627426
  hyper
agtactcagttgccacgtctcgcaggaactttggagcaagttttcagctcccaggtgtccaacctttaaaaggaaaagcataataatactaacctttctttcacgaccacgcgaaacg

SEQ ID NO: 9115 - DNA, 150 bp, Homo sapiens
  chr7:96635239-96635389
  hyper
agggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaac

SEQ ID NO: 9116 - DNA, 3 bp, Homo sapiens
  chr7:96635449-96635452
  hyper
agc

SEQ ID NO: 9117 - DNA, 104 bp, Homo sapiens
  chr7:96635486-96635590
  hyper
cgcgcactaccctctgcactgcctgcactcggcggcggcggcggcagcggccggctcgcaccaccaccaccaccaccagcaccaccaccacggctcgccctacg

SEQ ID NO: 9118 - DNA, 159 bp, Homo sapiens
  chr7:96635619-96635778
  hyper
cgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctacc

SEQ ID NO: 9119 - DNA, 340 bp, Homo sapiens; identical to SEQ ID NO: 692
  chr7:96636033-96636373
  hyper

SEQ ID NO: 9120 - DNA, 65 bp, Homo sapiens; identical to SEQ ID NO: 3072
  chr7:96636595-96636660
  hyper

SEQ ID NO: 9121 - DNA, 36 bp, Homo sapiens
  chr7:96642045-96642081
  hyper
gattggtaggaggggcgtgggcgaaaggcatcgccc

SEQ ID NO: 9122 - DNA, 157 bp, Homo sapiens
  chr7:96645902-96646059
  hyper
gaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttg

SEQ ID NO: 9123 - DNA, 469 bp, Homo sapiens
  chr7:96646662-96647131
  hyper
gaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaat

SEQ ID NO: 9124 - DNA, 370 bp, Homo sapiens; identical to SEQ ID NO: 3073
  chr7:96647849-96648219
  hyper

SEQ ID NO: 9125 - DNA, 41 bp, Homo sapiens
  chr7:96652088-96652129
  hyper
tgaccctacttctgtcggcgtctgttcgggcgcccgcagaa

SEQ ID NO: 9126 - DNA, 240 bp, Homo sapiens; identical to SEQ ID NO: 693
  chr7:96653580-96653820
  hyper

SEQ ID NO: 9127 - DNA, 131 bp, Homo sapiens; identical to SEQ ID NO: 694
  chr7:96653862-96653993
  hyper

SEQ ID NO: 9128 - DNA, 30 bp, Homo sapiens
  chr7:96656812-96656842
  hyper
gcggcttcggacccacgctcaggacataca

SEQ ID NO: 9129 - DNA, 99 bp, Homo sapiens
  chr7:97361029-97361128
  hyper
ggacggaaaagttaccgaagtccaaggaatgagtcactttgctcaaatttgatgagtaatatcaggtgtcatgaaacccagtttcgaaggagaggggag

SEQ ID NO: 9130 - DNA, 63 bp, Homo sapiens; identical to SEQ ID NO: 3076
  chr7:97361360-97361423
  hyper

SEQ ID NO: 9131 - DNA, 38 bp, Homo sapiens
  chr7:97361743-97361781
  hyper
gggacgcgattctctcgcctaaccggtacaggtgagac

SEQ ID NO: 9132 - DNA, 507 bp, Homo sapiens; identical to SEQ ID NO: 3077
  chr7:97362198-97362705
  hyper

SEQ ID NO: 9133 - DNA, 222 bp, Homo sapiens; identical to SEQ ID NO: 3078
  chr7:97362706-97362928
  hyper

SEQ ID NO: 9134 - DNA, 223 bp, Homo sapiens; identical to SEQ ID NO: 695
  chr7:98245856-98246079
  hyper

SEQ ID NO: 9135 - DNA, 204 bp, Homo sapiens; identical to SEQ ID NO: 696
  chr7:98246304-98246508
  hyper

SEQ ID NO: 9136 - DNA, 1085 bp, Homo sapiens; identical to SEQ ID NO: 697
  chr7:98246533-98247618
  hyper

SEQ ID NO: 9137 - DNA, 127 bp, Homo sapiens
  chr7:99149251-99149378
  hyper
cagaattttacaactcggggtacccaggaaaccagaaaagcccccaccacaagaaaaaccagtgggcacaactggggagcacagatatctgactggggtcattttgtccgcgcgtctttggggtaaa

SEQ ID NO: 9138 - DNA, 15 bp, Homo sapiens
  chr7:99155799-99155814
  hyper
aggccccgcaatcct

SEQ ID NO: 9139 - DNA, 195 bp, Homo sapiens
  chr7:99155931-99156126
  hyper
cgggccgcctccttgcagggagtctcaaggatgggctggcgtcagggaggggcccagggggcgctttcccaacactggtcgcagtcattgttggtataacggctagagacgcccagtgagttagcatggagggcagtgggaccggaaaaagacgtggaaaagctgcgaaaacgagccttcgaatcatggacgcgc

SEQ ID NO: 9140 - DNA, 50 bp, Homo sapiens
  chr7:99156127-99156177
  hyper
ggcccagctcctcctccgagttcctcatccggggccgtcactcacatccg

SEQ ID NO: 9141 - DNA, 100 bp, Homo sapiens
  chr7:99156815-99156915
  hyper
ccgctcaaacctgttcgaaccgcagctcttacctgcgttgctctcaggattccgggaaaaggccggtctagctggtctgagttagcgaagggcctgaccc

SEQ ID NO: 9142 - DNA, 176 bp, Homo sapiens
  chr7:99177694-99177870
  hyper
cggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagaga

SEQ ID NO: 9143 - DNA, 85 bp, Homo sapiens
  chr7:99178159-99178244
  hyper
ttcttgggaaagctccgcctaccattgcccttgtacctgccctctctctccctttcctgaagtgactgcccgtctctagcatcgt

SEQ ID NO: 9144 - DNA, 30 bp, Homo sapiens
  chr7:99595151-99595181
  hyper
aggtacgagtcactgcgcccaggcttttct

SEQ ID NO: 9145 - DNA, 16 bp, Homo sapiens
  chr7:100091165-100091181
  hyper
gcttctgaggggagac

SEQ ID NO: 9146 - DNA, 132 bp, Homo sapiens
  chr7:100167379-100167511
  hyper
actccagttcctgggcgacgtgaggattagtctcgtggggtgggggttccggagcggtcggcggagggagggaggtagtggggagcccaggccaggggcaacagtcaccgggacactcgctgtgcgcagagt

SEQ ID NO: 9147 - DNA, 32 bp, Homo sapiens
  chr7:100318466-100318498
  hyper
cgcgccccctggacagccgccctctcctccag

SEQ ID NO: 9148 - DNA, 30 bp, Homo sapiens
  chr7:100809491-100809521
  hyper
gatgggtggatcttgcggttttggtaatcc

SEQ ID NO: 9149 - DNA, 100 bp, Homo sapiens
  chr7:100823251-100823351
  hyper
tgctgccccattctgcggtggaggagcacgctagccccctccccagtccccaggcccggccgcccccctacctcgccggagccggagctggagccagggc

SEQ ID NO: 9150 - DNA, 179 bp, Homo sapiens
  chr7:100823380-100823559
  hyper
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcag

SEQ ID NO: 9151 - DNA, 30 bp, Homo sapiens
  chr7:100845392-100845422
  hyper
gccaggatcgcggggcggaggccggggctc

SEQ ID NO: 9152 - DNA, 52 bp, Homo sapiens
  chr7:100943301-100943353
  hyper
tgcagctgcagcccccgccaccccgagagtccagccccgagggcagctcctg

SEQ ID NO: 9153 - DNA, 127 bp, Homo sapiens
  chr7:101006326-101006453
  hyper
tgctcctgccctgggcgtgttgctgcctctgcgggtcggcgctggccaccggcttcctctatcccttctcggccgcagctctgcagcagcacggctaccccgagcccggcgccggctcccctggcag

SEQ ID NO: 9154 - DNA, 390 bp, Homo sapiens; identical to SEQ ID NO: 3082
  chr7:103085842-103086232
  hyper

SEQ ID NO: 9155 - DNA, 554 bp, Homo sapiens; identical to SEQ ID NO: 3083
  chr7:103629059-103629613
  hyper

SEQ ID NO: 9156 - DNA, 29 bp, Homo sapiens
  chr7:103630054-103630083
  hyper
gcctccgtgcgccgccgccgcctctgcgc

SEQ ID NO: 9157 - DNA, 109 bp, Homo sapiens
  chr7:103630363-103630472
  hyper
cgctgagcccgcgactcttctgcgagggacgtcaaagccccgcagagggcacctcccgtccagctgtctgaaggggaaggccagcccctttggccgtcagtgtgccctg

SEQ ID NO: 9158 - DNA, 47 bp, Homo sapiens
  chr7:103630841-103630888
  hyper
ggcggagctaagatccgacaggctctcttcgccggactgttctgtta

SEQ ID NO: 9159 - DNA, 251 bp, Homo sapiens; identical to SEQ ID NO: 3084
  chr7:103968915-103969166
  hyper

SEQ ID NO: 9160 - DNA, 355 bp, Homo sapiens; identical to SEQ ID NO: 3085
  chr7:103969167-103969522
  hyper

SEQ ID NO: 9161 - DNA, 15 bp, Homo sapiens
  chr7:103969562-103969577
  hyper
cggcctctccatgat

SEQ ID NO: 9162 - DNA, 766 bp, Homo sapiens; identical to SEQ ID NO: 3087
  chr7:107301015-107301781
  hyper

SEQ ID NO: 9163 - DNA, 30 bp, Homo sapiens
  chr7:107642639-107642669
  hyper
tgtgagcttgggaagcgagagtgcgtgtgc

SEQ ID NO: 9164 - DNA, 56 bp, Homo sapiens
  chr7:108095821-108095877
  hyper
ctcaacacagcatcccgggcggagcggatgccagatcccaccgctaagagcctggg

SEQ ID NO: 9165 - DNA, 30 bp, Homo sapiens
  chr7:108096780-108096810
  hyper
gctgctccagccaggcggcccctgcgccgt

SEQ ID NO: 9166 - DNA, 302 bp, Homo sapiens; identical to SEQ ID NO: 698
  chr7:108097189-108097491
  hyper

SEQ ID NO: 9167 - DNA, 57 bp, Homo sapiens
  chr7:112726853-112726910
  hyper
tcttcccaaaggcagcgcacgaggaagtcacagtgcccgtgacgcccgccccctccc

SEQ ID NO: 9168 - DNA, 105 bp, Homo sapiens
  chr7:113722810-113722915
  hyper
atctttcactaggaccgtactagagcagtgtctcgaattttgttgatttgtggtttcgtcgtaaaataaacttgaaatcaaataaactttcgtgaggaagctttg

SEQ ID NO: 9169 - DNA, 198 bp, Homo sapiens
  chr7:113723385-113723583
  hyper
caaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 9170 - DNA, 572 bp, Homo sapiens
  chr7:113724755-113725327
  hyper
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcct

SEQ ID NO: 9171 - DNA, 47 bp, Homo sapiens
  chr7:113726751-113726798
  hyper
ctttactctgctccgcgctcctcccgcggtggcgacaaagtttcgcc

SEQ ID NO: 9172 - DNA, 54 bp, Homo sapiens
  chr7:113727754-113727808
  hyper
cctctgcccacccgcgaggccgcaacgcgccctgacacccgacctcagtgtgga

SEQ ID NO: 9173 - DNA, 77 bp, Homo sapiens
  chr7:114562200-114562277
  hyper
cgagccagcccaggccggctctggcctcctgacccagacagcgcagggcgcgagggatcgcgcggccgagcccgggt

SEQ ID NO: 9174 - DNA, 4 bp, Homo sapiens
  chr7:114562326-114562330
  hyper
cgat

SEQ ID NO: 9175 - DNA, 372 bp, Homo sapiens
  chr7:114563009-114563381
  hyper
tcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgg

SEQ ID NO: 9176 - DNA, 227 bp, Homo sapiens
  chr7:115117500-115117727
  hyper
cgtctcggctgcctccgtggagatcccgagaaaagctcctgcgctccaagttaacttctctctgggccgcgcggcgcagtggagtctcggtgcagcccgcgtccctggaggcgcgcagcgaagcccagcgggcgtggacagggaaggggcgggaaggcaggggacaaggcggggtcctaagggttggtggggttgagctgggggggggggggcggaaaaagagatct

SEQ ID NO: 9177 - DNA, 503 bp, Homo sapiens; identical to SEQ ID NO: 699
  chr7:116962644-116963147
  hyper

SEQ ID NO: 9178 - DNA, 68 bp, Homo sapiens; identical to SEQ ID NO: 700
  chr7:116963330-116963398
  hyper

SEQ ID NO: 9179 - DNA, 32 bp, Homo sapiens
  chr7:116964126-116964158
  hyper
agaggggcttgggcccgcgggtggagcatttt

SEQ ID NO: 9180 - DNA, 40 bp, Homo sapiens
  chr7:116964570-116964610
  hyper
acccagatacatccccgtttgggtccggaaagggagggga

SEQ ID NO: 9181 - DNA, 392 bp, Homo sapiens; identical to SEQ ID NO: 701
  chr7:117119505-117119897
  hyper

SEQ ID NO: 9182 - DNA, 40 bp, Homo sapiens
  chr7:117120210-117120250
  hyper
tggccaaccgagcttcggaaagacacgtgcccacgaaaga

SEQ ID NO: 9183 - DNA, 60 bp, Homo sapiens
  chr7:119913034-119913094
  hyper
caccgcagcccagcacgtgaagcttccctttgttcatccgaggctcgcttttctccccag

SEQ ID NO: 9184 - DNA, 69 bp, Homo sapiens
  chr7:120969770-120969839
  hyper
gagccagttcagacacgagagatggaactgcatgatcaccgccgccgccactaccgccccgatgggcgc

SEQ ID NO: 9185 - DNA, 314 bp, Homo sapiens
  chr7:120970100-120970414
  hyper
tcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagca

SEQ ID NO: 9186 - DNA, 30 bp, Homo sapiens
  chr7:120970627-120970657
  hyper
tttcatgttcatttccgttccccctccgcc

SEQ ID NO: 9187 - DNA, 53 bp, Homo sapiens
  chr7:121513589-121513642
  hyper
ctcctctgtgtttgccgcctgggtgagtgagaagagctcggtggggtttcagc

SEQ ID NO: 9188 - DNA, 30 bp, Homo sapiens
  chr7:121783592-121783622
  hyper
cccagacttgcaaggcgcccaacttccacc

SEQ ID NO: 9189 - DNA, 40 bp, Homo sapiens
  chr7:121939677-121939717
  hyper
ggagctacttagggccgcatagattcggaatccagccaac

SEQ ID NO: 9190 - DNA, 254 bp, Homo sapiens; identical to SEQ ID NO: 702
  chr7:121939991-121940245
  hyper

SEQ ID NO: 9191 - DNA, 25 bp, Homo sapiens
  chr7:121940433-121940458
  hyper
cggtgtggaccgatggtggattctc

SEQ ID NO: 9192 - DNA, 149 bp, Homo sapiens
  chr7:121940903-121941052
  hyper
gaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgt

SEQ ID NO: 9193 - DNA, 306 bp, Homo sapiens; identical to SEQ ID NO: 704
  chr7:121941881-121942187
  hyper

SEQ ID NO: 9194 - DNA, 15 bp, Homo sapiens
  chr7:121943974-121943989
  hyper
ccgggtggcatgggc

SEQ ID NO: 9195 - DNA, 123 bp, Homo sapiens; identical to SEQ ID NO: 706
  chr7:121944176-121944299
  hyper

SEQ ID NO: 9196 - DNA, 49 bp, Homo sapiens
  chr7:121945680-121945729
  hyper
tttcttaagtacctgcgctcagctagagctctcccggagcattttaaat

SEQ ID NO: 9197 - DNA, 46 bp, Homo sapiens
  chr7:121946080-121946126
  hyper
cgctggaagctgcggcgcgcaccttccccggcgcagtctcttgcca

SEQ ID NO: 9198 - DNA, 488 bp, Homo sapiens; identical to SEQ ID NO: 707
  chr7:121946495-121946983
  hyper

SEQ ID NO: 9199 - DNA, 64 bp, Homo sapiens; identical to SEQ ID NO: 708
  chr7:121947097-121947161
  hyper

SEQ ID NO: 9200 - DNA, 128 bp, Homo sapiens; identical to SEQ ID NO: 709
  chr7:121950137-121950265
  hyper

SEQ ID NO: 9201 - DNA, 125 bp, Homo sapiens; identical to SEQ ID NO: 710
  chr7:121950428-121950553
  hyper

SEQ ID NO: 9202 - DNA, 148 bp, Homo sapiens; identical to SEQ ID NO: 711
  chr7:121951863-121952011
  hyper

SEQ ID NO: 9203 - DNA, 15 bp, Homo sapiens
  chr7:121952043-121952058
  hyper
cgagggtgggaaggg

SEQ ID NO: 9204 - DNA, 88 bp, Homo sapiens; identical to SEQ ID NO: 3103
  chr7:121955425-121955513
  hyper

SEQ ID NO: 9205 - DNA, 124 bp, Homo sapiens; identical to SEQ ID NO: 713
  chr7:121956458-121956582
  hyper

SEQ ID NO: 9206 - DNA, 123 bp, Homo sapiens; identical to SEQ ID NO: 714
  chr7:121956954-121957077
  hyper

SEQ ID NO: 9207 - DNA, 276 bp, Homo sapiens
  chr7:123172968-123173244
  hyper
ggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 9208 - DNA, 16 bp, Homo sapiens
  chr7:123672430-123672446
  hyper
gggagggacggggagc

SEQ ID NO: 9209 - DNA, 56 bp, Homo sapiens
  chr7:123672928-123672984
  hyper
ttcagcagtggacagcggctccgggcagccggctgccgcctcgcttcctggcccgc

SEQ ID NO: 9210 - DNA, 113 bp, Homo sapiens
  chr7:123673226-123673339
  hyper
tgcactcaggggactcgcgggccgcccggctagcggaatccccccgccgtggccccgctgcgccctcccttccagtcccgggcgaggtgccgcccgcccgcgcccgctctagc

SEQ ID NO: 9211 - DNA, 75 bp, Homo sapiens
  chr7:124404370-124404445
  hyper
ggccagcgcccggcccgggagtgcaattgtccacccttcgtgccccgccagtccattggccgtcttggacagggg

SEQ ID NO: 9212 - DNA, 191 bp, Homo sapiens
  chr7:124404769-124404960
  hyper
gtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagagg

SEQ ID NO: 9213 - DNA, 37 bp, Homo sapiens
  chr7:124405619-124405656
  hyper
cccacctaaccccagcgacttgcgagcctactgctgc

SEQ ID NO: 9214 - DNA, 44 bp, Homo sapiens
  chr7:124405918-124405962
  hyper
gaaggggaggtggcccggcctcgcccccgcgctccagccgctgc

SEQ ID NO: 9215 - DNA, 44 bp, Homo sapiens
  chr7:126891206-126891250
  hyper
gtctgttttcacccccgctatcttgggtgcgcagacactctctg

SEQ ID NO: 9216 - DNA, 730 bp, Homo sapiens
  chr7:126891633-126892363
  hyper
gatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgg

SEQ ID NO: 9217 - DNA, 153 bp, Homo sapiens; identical to SEQ ID NO: 715
  chr7:127744057-127744210
  hyper

SEQ ID NO: 9218 - DNA, 459 bp, Homo sapiens; identical to SEQ ID NO: 716
  chr7:127744211-127744670
  hyper

SEQ ID NO: 9219 - DNA, 36 bp, Homo sapiens
  chr7:127806571-127806607
  hyper
gggaacgccaatgcccgggagcggcctttgggagga

SEQ ID NO: 9220 - DNA, 835 bp, Homo sapiens; identical to SEQ ID NO: 3108
  chr7:127807845-127808680
  hyper

SEQ ID NO: 9221 - DNA, 159 bp, Homo sapiens; identical to SEQ ID NO: 3109
  chr7:127841338-127841497
  hyper

SEQ ID NO: 9222 - DNA, 97 bp, Homo sapiens
  chr7:127991826-127991923
  hyper
agggcccttccaggccggattggccgccgtagcccagggcgtgcagcacctcatagccctgcagggctccgctcagcagcccgaaggtgcccgccac

SEQ ID NO: 9223 - DNA, 91 bp, Homo sapiens
  chr7:127992044-127992135
  hyper
cgcccgccccagcaggagagcgccagcagcagcccggaaaggaaagcggcgagaaaggcgtgcagcccgcgcgaggcgagccgcaggggcc

SEQ ID NO: 9224 - DNA, 41 bp, Homo sapiens
  chr7:127992478-127992519
  hyper
aaccaggccgaagagcgcgcctaccccgtacacgtgggcct

SEQ ID NO: 9225 - DNA, 100 bp, Homo sapiens; identical to SEQ ID NO: 717
  chr7:128337422-128337522
  hyper

SEQ ID NO: 9226 - DNA, 13 bp, Homo sapiens
  chr7:128337582-128337595
  hyper
cgcctggaaatac

SEQ ID NO: 9227 - DNA, 134 bp, Homo sapiens; identical to SEQ ID NO: 719
  chr7:128337787-128337921
  hyper

SEQ ID NO: 9228 - DNA, 125 bp, Homo sapiens; identical to SEQ ID NO: 3113
  chr7:128430757-128430882
  hyper

SEQ ID NO: 9229 - DNA, 560 bp, Homo sapiens; identical to SEQ ID NO: 3114
  chr7:128470497-128471057
  hyper

SEQ ID NO: 9230 - DNA, 90 bp, Homo sapiens; identical to SEQ ID NO: 3115
  chr7:128471125-128471215
  hyper

SEQ ID NO: 9231 - DNA, 56 bp, Homo sapiens
  chr7:128510097-128510153
  hyper
gcccacgccccctcccgggcggcccccagctttgccaccgccggtgccgacctttg

SEQ ID NO: 9232 - DNA, 253 bp, Homo sapiens
  chr7:128828130-128828383
  hyper
tggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctc

SEQ ID NO: 9233 - DNA, 262 bp, Homo sapiens
  chr7:128829105-128829367
  hyper
gcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggtaagtgcggcggagccgggtctggggggcgggaggtgccgcgg

SEQ ID NO: 9234 - DNA, 30 bp, Homo sapiens
  chr7:129418279-129418309
  hyper
ttctttgcgtaaggccgactccagaggtcc

SEQ ID NO: 9235 - DNA, 8 bp, Homo sapiens
  chr7:129421701-129421709
  hyper
cccaggac

SEQ ID NO: 9236 - DNA, 854 bp, Homo sapiens; identical to SEQ ID NO: 721
  chr7:129422115-129422969
  hyper

SEQ ID NO: 9237 - DNA, 299 bp, Homo sapiens; identical to SEQ ID NO: 722
  chr7:129423125-129423424
  hyper

SEQ ID NO: 9238 - DNA, 1355 bp, Homo sapiens; identical to SEQ ID NO: 723
  chr7:129424591-129425946
  hyper

SEQ ID NO: 9239 - DNA, 62 bp, Homo sapiens
  chr7:131242762-131242824
  hyper
attaaccttggaacccgggtacggcgtaaatttggctcacgtgactccggggttgctaatct

SEQ ID NO: 9240 - DNA, 30 bp, Homo sapiens
  chr7:132260536-132260566
  hyper
cacgcttcagaaaggcgtttgtgctgcctc

SEQ ID NO: 9241 - DNA, 89 bp, Homo sapiens
  chr7:132260852-132260941
  hyper
ggtgggaggcagagccgggaatacacagaatcccaccccgaaagtcccgggaaagagaagtctgagtccaggagcgtgagaggagaaca

SEQ ID NO: 9242 - DNA, 141 bp, Homo sapiens
  chr7:132261845-132261986
  hyper
ctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagg

SEQ ID NO: 9243 - DNA, 532 bp, Homo sapiens
  chr7:134143055-134143587
  hyper
attatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 9244 - DNA, 164 bp, Homo sapiens; identical to SEQ ID NO: 3120
  chr7:134143807-134143971
  hyper

SEQ ID NO: 9245 - DNA, 83 bp, Homo sapiens; identical to SEQ ID NO: 3121
  chr7:134143972-134144055
  hyper

SEQ ID NO: 9246 - DNA, 76 bp, Homo sapiens; identical to SEQ ID NO: 3122
  chr7:134144056-134144132
  hyper

SEQ ID NO: 9247 - DNA, 99 bp, Homo sapiens; identical to SEQ ID NO: 3123
  chr7:136553927-136554026
  hyper

SEQ ID NO: 9248 - DNA, 263 bp, Homo sapiens; identical to SEQ ID NO: 3124
  chr7:136554103-136554366
  hyper

SEQ ID NO: 9249 - DNA, 63 bp, Homo sapiens; identical to SEQ ID NO: 3125
  chr7:136554903-136554966
  hyper

SEQ ID NO: 9250 - DNA, 89 bp, Homo sapiens
  chr7:136555702-136555791
  hyper
gtggcagtgggtatgcggcagccgtgtgatttgcccatcccctagtacacgcagccagcgacacaagcacacagcgaccagtccccacg

SEQ ID NO: 9251 - DNA, 627 bp, Homo sapiens; identical to SEQ ID NO: 724
  chr7:137531262-137531889
  hyper

SEQ ID NO: 9252 - DNA, 176 bp, Homo sapiens; identical to SEQ ID NO: 725
  chr7:137531908-137532084
  hyper

SEQ ID NO: 9253 - DNA, 105 bp, Homo sapiens; identical to SEQ ID NO: 3128
  chr7:139167722-139167827
  hyper

SEQ ID NO: 9254 - DNA, 423 bp, Homo sapiens; identical to SEQ ID NO: 3129
  chr7:139168114-139168537
  hyper

SEQ ID NO: 9255 - DNA, 55 bp, Homo sapiens
  chr7:139208245-139208300
  hyper
tagaaccaggtctcccggctccaagactgcgctcccagctcgacagcatccagcc

SEQ ID NO: 9256 - DNA, 133 bp, Homo sapiens; identical to SEQ ID NO: 3130
  chr7:139208629-139208762
  hyper

SEQ ID NO: 9257 - DNA, 15 bp, Homo sapiens
  chr7:140339853-140339868
  hyper
gcccggctgctcagc

SEQ ID NO: 9258 - DNA, 40 bp, Homo sapiens
  chr7:140771769-140771809
  hyper
ccattaaatttctctcgtcttgagtcgatcagccaaattt

SEQ ID NO: 9259 - DNA, 246 bp, Homo sapiens
  chr7:140772343-140772589
  hyper
aagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagagg

SEQ ID NO: 9260 - DNA, 1196 bp, Homo sapiens
  chr7:140773024-140774220
  hyper
cgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccag

SEQ ID NO: 9261 - DNA, 212 bp, Homo sapiens
  chr7:143579739-143579951
  hyper
ccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagc

SEQ ID NO: 9262 - DNA, 143 bp, Homo sapiens
  chr7:143579952-143580095
  hyper
gggaggaggctggagctggaggagaggaggggtttccacgggagtcccctcctccccacttcctcccaggctggagtgggagctccagggggcggcgcttggcgggggacagcgcttctttgtgtcgccggccctggtggctt

SEQ ID NO: 9263 - DNA, 113 bp, Homo sapiens; identical to SEQ ID NO: 3131
  chr7:145813015-145813128
  hyper

SEQ ID NO: 9264 - DNA, 33 bp, Homo sapiens
  chr7:145813544-145813577
  hyper
ctgcaccaccgtccccgtcgctctgccttcctc

SEQ ID NO: 9265 - DNA, 72 bp, Homo sapiens
  chr7:145813945-145814017
  hyper
cgccgccggccgggaggcgaaggatgcaggcggctccgcgcgccggctgcggggcagcgctcctgctgtgga

SEQ ID NO: 9266 - DNA, 113 bp, Homo sapiens; identical to SEQ ID NO: 726
  chr7:149112136-149112249
  hyper

SEQ ID NO: 9267 - DNA, 30 bp, Homo sapiens
  chr7:149119930-149119960
  hyper
gcgccaaatggagggcgcagggttttagga

SEQ ID NO: 9268 - DNA, 246 bp, Homo sapiens
  chr7:149411482-149411728
  hyper
ggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 9269 - DNA, 530 bp, Homo sapiens
  chr7:149411834-149412364
  hyper
cgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccac

SEQ ID NO: 9270 - DNA, 57 bp, Homo sapiens
  chr7:149744469-149744526
  hyper
ccagccaccaactcccggccgccgcggctgcagacacagacccgctccctccgggac

SEQ ID NO: 9271 - DNA, 4 bp, Homo sapiens
  chr7:149744795-149744799
  hyper
cctg

SEQ ID NO: 9272 - DNA, 65 bp, Homo sapiens
  chr7:149744950-149745015
  hyper
cgcgctcctgctggctgtctttagggctttttaatattttgctttctctccggttcccactcccc

SEQ ID NO: 9273 - DNA, 56 bp, Homo sapiens; identical to SEQ ID NO: 3133
  chr7:149917321-149917377
  hyper

SEQ ID NO: 9274 - DNA, 103 bp, Homo sapiens
  chr7:150716169-150716272
  hyper
gcagctcccagcccccgcggaagagcgagaagggaccgcggaagagcagcaggtcgacattgagcgccaggccgcggctgaggaaagccgcactgcctcccca

SEQ ID NO: 9275 - DNA, 361 bp, Homo sapiens
  chr7:150748158-150748519
  hyper
agaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccg

SEQ ID NO: 9276 - DNA, 165 bp, Homo sapiens
  chr7:150864232-150864397
  hyper
ttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccgg

SEQ ID NO: 9277 - DNA, 148 bp, Homo sapiens; identical to SEQ ID NO: 3134
  chr7:151106418-151106566
  hyper

SEQ ID NO: 9278 - DNA, 400 bp, Homo sapiens; identical to SEQ ID NO: 3135
  chr7:151106589-151106989
  hyper

SEQ ID NO: 9279 - DNA, 181 bp, Homo sapiens; identical to SEQ ID NO: 3136
  chr7:151107395-151107576
  hyper

SEQ ID NO: 9280 - DNA, 30 bp, Homo sapiens
  chr7:151107782-151107812
  hyper
ttccggcgccgacttcgctggggacgggga

SEQ ID NO: 9281 - DNA, 175 bp, Homo sapiens
  chr7:151145538-151145713
  hyper
cggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagc

SEQ ID NO: 9282 - DNA, 30 bp, Homo sapiens
  chr7:152622731-152622761
  hyper
cggcctgagcccctgcggtgattccccagg

SEQ ID NO: 9283 - DNA, 117 bp, Homo sapiens
  chr7:153446175-153446292
  hyper
cggcaggtttgtggagggagtgtgagcagccgctggtgcgtctgcatgccttgcaggggtcggtgactgaggatggttggcggatcgcgggggttgagagaacgtgtgctgttttgt

SEQ ID NO: 9284 - DNA, 64 bp, Homo sapiens
  chr7:153583466-153583530
  hyper
ggttagagaaatgggcgctgggatttggccccggccagtgctggggttccagggtagggagagc

SEQ ID NO: 9285 - DNA, 71 bp, Homo sapiens; identical to SEQ ID NO: 3137
  chr7:153583933-153584004
  hyper

SEQ ID NO: 9286 - DNA, 30 bp, Homo sapiens
  chr7:153584421-153584451
  hyper
gtcagagctgcctctcgccctcgctagctg

SEQ ID NO: 9287 - DNA, 180 bp, Homo sapiens
  chr7:153584889-153585069
  hyper
tgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggcttt

SEQ ID NO: 9288 - DNA, 194 bp, Homo sapiens; identical to SEQ ID NO: 3138
  chr7:153749733-153749927
  hyper

SEQ ID NO: 9289 - DNA, 40 bp, Homo sapiens
  chr7:153750249-153750289
  hyper
cgccctccccccgcccacgactctccgggcgcccccagac

SEQ ID NO: 9290 - DNA, 10 bp, Homo sapiens
  chr7:154002083-154002093
  hyper
cgctgcctcc

SEQ ID NO: 9291 - DNA, 89 bp, Homo sapiens
  chr7:154861818-154861907
  hyper
tgctcccgggcggggcgaggtggcagcaccgcggacagcaccacatgtggtggcgcacactgggagccgccaggcgcggggagcgcagc

SEQ ID NO: 9292 - DNA, 131 bp, Homo sapiens
  chr7:154862176-154862307
  hyper
tgggcagggagacaacgcggtgagagcgactgctctgacgcaccagcccctctcctgcacccacacgctgctggccgcccagcttctccccgatctgggagatgctcggctctgggcggccaaacagcctt

SEQ ID NO: 9293 - DNA, 2593 bp, Homo sapiens; identical to SEQ ID NO: 727
  chr7:155164445-155167038
  hyper

SEQ ID NO: 9294 - DNA, 51 bp, Homo sapiens; identical to SEQ ID NO: 728
  chr7:155167039-155167090
  hyper

SEQ ID NO: 9295 - DNA, 487 bp, Homo sapiens; identical to SEQ ID NO: 729
  chr7:155167174-155167661
  hyper

SEQ ID NO: 9296 - DNA, 77 bp, Homo sapiens
  chr7:155168537-155168614
  hyper
tgccaggcgacgtttcgtggttgtatttggcccactaaatcctaggtcgctcttcctatgtacgactgtagactcac

SEQ ID NO: 9297 - DNA, 202 bp, Homo sapiens
  chr7:155170276-155170478
  hyper
ccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggac

SEQ ID NO: 9298 - DNA, 89 bp, Homo sapiens
  chr7:155170836-155170925
  hyper
gcttgagggctgctccgcatagaccaacgtccggggaaggcacacagtggccgagggcccgcgcgcttgggctacggctgtgatggtat

SEQ ID NO: 9299 - DNA, 78 bp, Homo sapiens
  chr7:155173869-155173947
  hyper
cttcaccttccaaaccgcagtccctggtgatcctgacttttgcagcctggctctgggtccacacggggctggagaagg

SEQ ID NO: 9300 - DNA, 634 bp, Homo sapiens; identical to SEQ ID NO: 3142
  chr7:155174224-155174858
  hyper

SEQ ID NO: 9301 - DNA, 61 bp, Homo sapiens; identical to SEQ ID NO: 730
  chr7:155241429-155241490
  hyper

SEQ ID NO: 9302 - DNA, 738 bp, Homo sapiens; identical to SEQ ID NO: 731
  chr7:155241491-155242229
  hyper

SEQ ID NO: 9303 - DNA, 742 bp, Homo sapiens; identical to SEQ ID NO: 3145
  chr7:155242699-155243441
  hyper

SEQ ID NO: 9304 - DNA, 67 bp, Homo sapiens
  chr7:155243755-155243822
  hyper
cggttttgttttccaggggtagtttctgcagaaaggagattctcctccgggccgaagggctaccagc

SEQ ID NO: 9305 - DNA, 208 bp, Homo sapiens; identical to SEQ ID NO: 3146
  chr7:155244031-155244239
  hyper

SEQ ID NO: 9306 - DNA, 491 bp, Homo sapiens; identical to SEQ ID NO: 732
  chr7:155246989-155247480
  hyper

SEQ ID NO: 9307 - DNA, 37 bp, Homo sapiens
  chr7:155248008-155248045
  hyper
ctctgcccaccggcccgccaggcgccctggaggtgac

SEQ ID NO: 9308 - DNA, 88 bp, Homo sapiens
  chr7:155249117-155249205
  hyper
taaatgatggacaggcgagcctggggtaacaacgggtgtttggtgggtagacaagagcaaatgggaaggagcccgagggaggaggggg

SEQ ID NO: 9309 - DNA, 111 bp, Homo sapiens; identical to SEQ ID NO: 3148
  chr7:155249900-155250011
  hyper

SEQ ID NO: 9310 - DNA, 430 bp, Homo sapiens
  chr7:155250387-155250817
  hyper
cgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctct

SEQ ID NO: 9311 - DNA, 123 bp, Homo sapiens
  chr7:155251427-155251550
  hyper
agcagctcttgggctcgggctcccgagagccccggcagaacccgccatgtgcgcccggcgcgggcgggccgctcccagccgccggcagcgactctccgggtgacggggaaggcggctccaaga

SEQ ID NO: 9312 - DNA, 100 bp, Homo sapiens; identical to SEQ ID NO: 3149
  chr7:155252162-155252262
  hyper

SEQ ID NO: 9313 - DNA, 146 bp, Homo sapiens; identical to SEQ ID NO: 3150
  chr7:155252316-155252462
  hyper

SEQ ID NO: 9314 - DNA, 156 bp, Homo sapiens
  chr7:155252910-155253066
  hyper
acaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgg

SEQ ID NO: 9315 - DNA, 423 bp, Homo sapiens; identical to SEQ ID NO: 733
  chr7:155254901-155255324
  hyper

SEQ ID NO: 9316 - DNA, 2 bp, Homo sapiens
  chr7:155256231-155256233
  hyper
ac

SEQ ID NO: 9317 - DNA, 44 bp, Homo sapiens; identical to SEQ ID NO: 3153
  chr7:155256268-155256312
  hyper

SEQ ID NO: 9318 - DNA, 792 bp, Homo sapiens; identical to SEQ ID NO: 734
  chr7:155258072-155258864
  hyper

SEQ ID NO: 9319 - DNA, 164 bp, Homo sapiens; identical to SEQ ID NO: 735
  chr7:155258914-155259078
  hyper

SEQ ID NO: 9320 - DNA, 504 bp, Homo sapiens; identical to SEQ ID NO: 736
  chr7:155259119-155259623
  hyper

SEQ ID NO: 9321 - DNA, 12 bp, Homo sapiens
  chr7:155259833-155259845
  hyper
cggggattcgcc

SEQ ID NO: 9322 - DNA, 112 bp, Homo sapiens; identical to SEQ ID NO: 738
  chr7:155259846-155259958
  hyper

SEQ ID NO: 9323 - DNA, 99 bp, Homo sapiens; identical to SEQ ID NO: 739
  chr7:155260038-155260137
  hyper

SEQ ID NO: 9324 - DNA, 106 bp, Homo sapiens; identical to SEQ ID NO: 3160
  chr7:155260785-155260891
  hyper

SEQ ID NO: 9325 - DNA, 140 bp, Homo sapiens; identical to SEQ ID NO: 3161
  chr7:155261070-155261210
  hyper

SEQ ID NO: 9326 - DNA, 215 bp, Homo sapiens
  chr7:155264127-155264342
  hyper
gaaacaaaaacagcacgtcagaggaagaatgtcatacaaacccgctggagtcacaaggcaaaacagcccccatacctaaacgcccggcgtgacaatggcctttgtgcctggcgccgtcggggggagctgggcgcctagcgggtggggcaggcggaagttggacacatttccacgcaggtgaggccatccatggggtgatgcgggtgttggggctc

SEQ ID NO: 9327 - DNA, 197 bp, Homo sapiens; identical to SEQ ID NO: 740
  chr7:155301753-155301950
  hyper

SEQ ID NO: 9328 - DNA, 346 bp, Homo sapiens; identical to SEQ ID NO: 741
  chr7:155302372-155302718
  hyper

SEQ ID NO: 9329 - DNA, 188 bp, Homo sapiens; identical to SEQ ID NO: 742
  chr7:155302963-155303151
  hyper

SEQ ID NO: 9330 - DNA, 33 bp, Homo sapiens
  chr7:155325796-155325829
  hyper
gagtaaccaagcatacgccgtacagtgacaaca

SEQ ID NO: 9331 - DNA, 372 bp, Homo sapiens; identical to SEQ ID NO: 3165
  chr7:155326169-155326541
  hyper

SEQ ID NO: 9332 - DNA, 45 bp, Homo sapiens
  chr7:155580181-155580226
  hyper
gggccgcccctgtctcgggccctgccgcgccgcccgcccgctgca

SEQ ID NO: 9333 - DNA, 41 bp, Homo sapiens
  chr7:156409472-156409513
  hyper
tcctcgccccgaccccgcgcccctgcgcccgggctccagcc

SEQ ID NO: 9334 - DNA, 75 bp, Homo sapiens
  chr7:156409727-156409802
  hyper
cgcgctcagccgggtgaacctggaactgtgttcctggcccagcgctttcataaaagggcgcggaatagtaagtcc

SEQ ID NO: 9335 - DNA, 21 bp, Homo sapiens
  chr7:156794464-156794485
  hyper
ccactgcgcccagcctgattt

SEQ ID NO: 9336 - DNA, 288 bp, Homo sapiens; identical to SEQ ID NO: 744
  chr7:156795067-156795355
  hyper

SEQ ID NO: 9337 - DNA, 235 bp, Homo sapiens; identical to SEQ ID NO: 745
  chr7:156795401-156795636
  hyper

SEQ ID NO: 9338 - DNA, 114 bp, Homo sapiens; identical to SEQ ID NO: 746
  chr7:156795899-156796013
  hyper

SEQ ID NO: 9339 - DNA, 246 bp, Homo sapiens; identical to SEQ ID NO: 747
  chr7:156796494-156796740
  hyper

SEQ ID NO: 9340 - DNA, 355 bp, Homo sapiens; identical to SEQ ID NO: 748
  chr7:156797005-156797360
  hyper

SEQ ID NO: 9341 - DNA, 828 bp, Homo sapiens; identical to SEQ ID NO: 749
  chr7:156797607-156798435
  hyper

SEQ ID NO: 9342 - DNA, 621 bp, Homo sapiens; identical to SEQ ID NO: 750
  chr7:156798526-156799147
  hyper

SEQ ID NO: 9343 - DNA, 50 bp, Homo sapiens; identical to SEQ ID NO: 751
  chr7:156799290-156799340
  hyper

SEQ ID NO: 9344 - DNA, 139 bp, Homo sapiens
  chr7:156800933-156801072
  hyper
ccgtgggcaacttagcgtccttggctctgggaaatgcaggtcatattggtggctttctatcagaagggatgggccctgggtcggcaccctgggtttaagcccaggctggcaggggattcgcagacgcagacgtgtctga

SEQ ID NO: 9345 - DNA, 434 bp, Homo sapiens; identical to SEQ ID NO: 752
  chr7:156801438-156801872
  hyper

SEQ ID NO: 9346 - DNA, 30 bp, Homo sapiens
  chr7:156809193-156809223
  hyper
gtccaagtccatgttcgataatggcaggaa

SEQ ID NO: 9347 - DNA, 105 bp, Homo sapiens
  chr7:156810064-156810169
  hyper
caccgaggggcaaaccggctgaggacccaggcacgaagagtgtcaccagctctgaccacaagccccgtagaccagggctgcgtccataatcggggttgatggcat

SEQ ID NO: 9348 - DNA, 31 bp, Homo sapiens; identical to SEQ ID NO: 753
  chr7:156810491-156810522
  hyper

SEQ ID NO: 9349 - DNA, 204 bp, Homo sapiens; identical to SEQ ID NO: 754
  chr7:156810597-156810801
  hyper

SEQ ID NO: 9350 - DNA, 104 bp, Homo sapiens; identical to SEQ ID NO: 755
  chr7:156811302-156811406
  hyper

SEQ ID NO: 9351 - DNA, 38 bp, Homo sapiens
  chr7:156811672-156811710
  hyper
cctggagccgagggacgccccgacggacctcgggcctc

SEQ ID NO: 9352 - DNA, 974 bp, Homo sapiens; identical to SEQ ID NO: 756
  chr7:156812852-156813826
  hyper

SEQ ID NO: 9353 - DNA, 244 bp, Homo sapiens; identical to SEQ ID NO: 757
  chr7:156813986-156814230
  hyper

SEQ ID NO: 9354 - DNA, 11 bp, Homo sapiens
  chr7:156871282-156871293
  hyper
cgagctccaga

SEQ ID NO: 9355 - DNA, 71 bp, Homo sapiens
  chr7:157129160-157129231
  hyper
gccggcgccttcgcccgccttcgctggccgccgcttggtttgttcttcttctccttcggggacttctccgc

SEQ ID NO: 9356 - DNA, 55 bp, Homo sapiens
  chr7:157476914-157476969
  hyper
ctgagttaatggaaacgcgggttaaatgagaaaagacgcccggattttcctgcct

SEQ ID NO: 9357 - DNA, 16 bp, Homo sapiens
  chr7:157477473-157477489
  hyper
gggccggggtctcctc

SEQ ID NO: 9358 - DNA, 107 bp, Homo sapiens; identical to SEQ ID NO: 759
  chr7:157477710-157477817
  hyper

SEQ ID NO: 9359 - DNA, 17 bp, Homo sapiens
  chr7:157481533-157481550
  hyper
cgtccctcccccctcgc

SEQ ID NO: 9360 - DNA, 227 bp, Homo sapiens; identical to SEQ ID NO: 3184
  chr7:157481847-157482074
  hyper

SEQ ID NO: 9361 - DNA, 110 bp, Homo sapiens
  chr7:157482557-157482667
  hyper
gatactcccatggctcggaggcgcgctcccggaccctggtgaggagggtgaagagcgccccaaaatgggctgagaggaaaatgcgcccacactggcgcctctccatcctg

SEQ ID NO: 9362 - DNA, 239 bp, Homo sapiens; identical to SEQ ID NO: 3185
  chr7:157483274-157483513
  hyper

SEQ ID NO: 9363 - DNA, 83 bp, Homo sapiens
  chr7:157483738-157483821
  hyper
caccggttgctatagcgatgtccccccccccccccacatgttgctgacagcaattggctaaggggccgcggctctccaaacac

SEQ ID NO: 9364 - DNA, 75 bp, Homo sapiens
  chr7:157484507-157484582
  hyper
cgagaagagctagggtctcggggcgactaggaccactgagcacctcccccccgcgcctcccgcccatgctctctc

SEQ ID NO: 9365 - DNA, 99 bp, Homo sapiens; identical to SEQ ID NO: 3186
  chr7:157485503-157485602
  hyper

SEQ ID NO: 9366 - DNA, 15 bp, Homo sapiens
  chr7:157485649-157485664
  hyper
cggttcctgtccctc

SEQ ID NO: 9367 - DNA, 68 bp, Homo sapiens; identical to SEQ ID NO: 3188
  chr7:157486014-157486082
  hyper

SEQ ID NO: 9368 - DNA, 211 bp, Homo sapiens; identical to SEQ ID NO: 3189
  chr7:157486204-157486415
  hyper

SEQ ID NO: 9369 - DNA, 28 bp, Homo sapiens
  chr7:157486475-157486503
  hyper
cgccctggatcgccggagcctcatccag

SEQ ID NO: 9370 - DNA, 162 bp, Homo sapiens
  chr7:158936595-158936757
  hyper
ccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccg

SEQ ID NO: 9371 - DNA, 129 bp, Homo sapiens; identical to SEQ ID NO: 3191
  chr7:158937202-158937331
  hyper

SEQ ID NO: 9372 - DNA, 91 bp, Homo sapiens
  chr7:158938315-158938406
  hyper
gggttttgtgtcctgcgtttgcaaaacgggggtcattctctccccgcaaacgcggcggcgggtggggaacgctgggcggggactcacgcgg

SEQ ID NO: 9373 - DNA, 82 bp, Homo sapiens
  chr8:495729-495811
  hyper
ggtgggcggtggggccgctggggcctggggcgccgcgggctcggcccggactgacggcggtggggggcggggatggggccgt

SEQ ID NO: 9374 - DNA, 56 bp, Homo sapiens; identical to SEQ ID NO: 3192
  chr8:687162-687218
  hyper

SEQ ID NO: 9375 - DNA, 129 bp, Homo sapiens; identical to SEQ ID NO: 3193
  chr8:687513-687642
  hyper

SEQ ID NO: 9376 - DNA, 139 bp, Homo sapiens; identical to SEQ ID NO: 3194
  chr8:687837-687976
  hyper

SEQ ID NO: 9377 - DNA, 46 bp, Homo sapiens
  chr8:4849490-4849536
  hyper
gtcctggaccccctccgcgcgcacacacttgcgcacagcacctctc

SEQ ID NO: 9378 - DNA, 60 bp, Homo sapiens
  chr8:4850456-4850516
  hyper
ggagctggtgctgagcggtcagctttcacggagccctggacgccccgtggaggcaagtgc

SEQ ID NO: 9379 - DNA, 46 bp, Homo sapiens
  chr8:4851880-4851926
  hyper
acagcaccagcagcccgagaagcaggagcagcgactggaatctcct

SEQ ID NO: 9380 - DNA, 68 bp, Homo sapiens
  chr8:4852501-4852569
  hyper
gacagagcccagcctcggggcctcgggctgcccgcaccgtgctgcgcttcattcggcctcagcgcagc

SEQ ID NO: 9381 - DNA, 30 bp, Homo sapiens
  chr8:6692832-6692862
  hyper
gcgcgcagtgctgggcgcaggctggggcag

SEQ ID NO: 9382 - DNA, 194 bp, Homo sapiens
  chr8:9756090-9756284
  hyper
aacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 9383 - DNA, 15 bp, Homo sapiens
  chr8:9756486-9756501
  hyper
cgctagagtgaaatc

SEQ ID NO: 9384 - DNA, 104 bp, Homo sapiens; identical to SEQ ID NO: 3195
  chr8:9762586-9762690
  hyper

SEQ ID NO: 9385 - DNA, 540 bp, Homo sapiens; identical to SEQ ID NO: 3196
  chr8:9762751-9763291
  hyper

SEQ ID NO: 9386 - DNA, 197 bp, Homo sapiens; identical to SEQ ID NO: 3197
  chr8:9763565-9763762
  hyper

SEQ ID NO: 9387 - DNA, 263 bp, Homo sapiens; identical to SEQ ID NO: 3198
  chr8:9763787-9764050
  hyper

SEQ ID NO: 9388 - DNA, 718 bp, Homo sapiens; identical to SEQ ID NO: 3199
  chr8:9764195-9764913
  hyper

SEQ ID NO: 9389 - DNA, 131 bp, Homo sapiens
  chr8:10587422-10587553
  hyper
ccccgccccctggggcgccgatctccgctcctgtcccagcagaggagcctccctgcccgccgcgcggtttcactttggaccgcgccaagtgcccccgctctgaatcctgggcaccgcgagcacccacgctc

SEQ ID NO: 9390 - DNA, 216 bp, Homo sapiens
  chr8:11204810-11205026
  hyper
cagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgt

SEQ ID NO: 9391 - DNA, 249 bp, Homo sapiens
  chr8:11205453-11205702
  hyper
gcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 9392 - DNA, 61 bp, Homo sapiens
  chr8:11206007-11206068
  hyper
gcgcacacagctaggcgggccgcgggccgcgaccccctggctggtccgtgctctccccctg

SEQ ID NO: 9393 - DNA, 30 bp, Homo sapiens
  chr8:11536827-11536857
  hyper
gggggaggaaggggacgtttctagaagaaa

SEQ ID NO: 9394 - DNA, 104 bp, Homo sapiens
  chr8:11537179-11537283
  hyper
gagccctgagtgggccgggtgctgggcgaacagtcctagccctgcactgaggttggaaaagcgaacggaaagtgacatttttacaggggcgaggttgggatcgg

SEQ ID NO: 9395 - DNA, 50 bp, Homo sapiens
  chr8:11550672-11550722
  hyper
agcttagaaatgattcggcaagctgggcgcggtggcgcatatttgtaatc

SEQ ID NO: 9396 - DNA, 7 bp, Homo sapiens
  chr8:11555160-11555167
  hyper
aggaccc

SEQ ID NO: 9397 - DNA, 51 bp, Homo sapiens
  chr8:11560067-11560118
  hyper
gtgctccggagaccgcttttccgcagcgccggcctccgagatccccagcac

SEQ ID NO: 9398 - DNA, 30 bp, Homo sapiens
  chr8:11560481-11560511
  hyper
cccgcgtcctggcctcgtccttaacccccg

SEQ ID NO: 9399 - DNA, 141 bp, Homo sapiens; identical to SEQ ID NO: 3200
  chr8:11560711-11560852
  hyper

SEQ ID NO: 9400 - DNA, 30 bp, Homo sapiens
  chr8:11561116-11561146
  hyper
tgaggcctgggctcccgaccatctccctgg

SEQ ID NO: 9401 - DNA, 282 bp, Homo sapiens; identical to SEQ ID NO: 3201
  chr8:11561442-11561724
  hyper

SEQ ID NO: 9402 - DNA, 471 bp, Homo sapiens; identical to SEQ ID NO: 3202
  chr8:11561725-11562196
  hyper

SEQ ID NO: 9403 - DNA, 146 bp, Homo sapiens; identical to SEQ ID NO: 3203
  chr8:11562235-11562381
  hyper

SEQ ID NO: 9404 - DNA, 104 bp, Homo sapiens; identical to SEQ ID NO: 3204
  chr8:11562627-11562731
  hyper

SEQ ID NO: 9405 - DNA, 36 bp, Homo sapiens
  chr8:12808858-12808894
  hyper
cgcgctaaagccaagcgtcgtcgtcacccaaggtac

SEQ ID NO: 9406 - DNA, 247 bp, Homo sapiens
  chr8:12989381-12989628
  hyper
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctcc

SEQ ID NO: 9407 - DNA, 236 bp, Homo sapiens
  chr8:12991090-12991326
  hyper
ggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcgga

SEQ ID NO: 9408 - DNA, 134 bp, Homo sapiens
  chr8:15094433-15094567
  hyper
ccccggacctgctcccgcgcctggggctagggcaggctagccgtccccggcagcgggggtacctctccagcccctgcactgcaactgcgggaggaaacactgcccgcgggcggtgggagggaaaaggggtctca

SEQ ID NO: 9409 - DNA, 93 bp, Homo sapiens
  chr8:16859361-16859454
  hyper
caggtgcgccagctgcgcagcccccggcccgccgcgcgcgctccgctccgccgcgctcctgcgctcgcccagcagcggcggccgctccccggc

SEQ ID NO: 9410 - DNA, 30 bp, Homo sapiens
  chr8:16884436-16884466
  hyper
gccgcgcctcagttacgctgactcggctgt

SEQ ID NO: 9411 - DNA, 30 bp, Homo sapiens
  chr8:16884959-16884989
  hyper
tggaggcggcggcggcgctggggggagctg

SEQ ID NO: 9412 - DNA, 153 bp, Homo sapiens
  chr8:19797866-19798019
  hyper
ggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 9413 - DNA, 149 bp, Homo sapiens
  chr8:20161245-20161394
  hyper
cttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcact

SEQ ID NO: 9414 - DNA, 34 bp, Homo sapiens
  chr8:20161617-20161651
  hyper
acagctggggctgctcgcgacctcgcggctcctt

SEQ ID NO: 9415 - DNA, 32 bp, Homo sapiens
  chr8:20161666-20161698
  hyper
cgcggggtcccgggtcccgtctctctgctctc

SEQ ID NO: 9416 - DNA, 30 bp, Homo sapiens
  chr8:22613837-22613867
  hyper
agagacccttaaccccggacagccccagct

SEQ ID NO: 9417 - DNA, 134 bp, Homo sapiens
  chr8:22960648-22960782
  hyper
caagaccctaaagttcgtcgtcgtcatcgtcgcggtcctgctgccagtgagtcccggccgcggtccctggctggggaagagcgcacctggcgccgggagggggcagggagacggggacacggcagggatgcctg

SEQ ID NO: 9418 - DNA, 147 bp, Homo sapiens
  chr8:23021380-23021527
  hyper
ctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttc

SEQ ID NO: 9419 - DNA, 159 bp, Homo sapiens
  chr8:23260834-23260993
  hyper
gcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtc

SEQ ID NO: 9420 - DNA, 160 bp, Homo sapiens
  chr8:23261393-23261553
  hyper
gagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttc

SEQ ID NO: 9421 - DNA, 50 bp, Homo sapiens; identical to SEQ ID NO: 760
  chr8:23559552-23559602
  hyper

SEQ ID NO: 9422 - DNA, 972 bp, Homo sapiens; identical to SEQ ID NO: 761
  chr8:23559665-23560637
  hyper

SEQ ID NO: 9423 - DNA, 230 bp, Homo sapiens; identical to SEQ ID NO: 762
  chr8:23564830-23565060
  hyper

SEQ ID NO: 9424 - DNA, 15 bp, Homo sapiens
  chr8:23566840-23566855
  hyper
aacttagaatatttc

SEQ ID NO: 9425 - DNA, 15 bp, Homo sapiens
  chr8:23566900-23566915
  hyper
cgctgggttctcgcc

SEQ ID NO: 9426 - DNA, 54 bp, Homo sapiens; identical to SEQ ID NO: 3210
  chr8:23567116-23567170
  hyper

SEQ ID NO: 9427 - DNA, 292 bp, Homo sapiens; identical to SEQ ID NO: 763
  chr8:23571681-23571973
  hyper

SEQ ID NO: 9428 - DNA, 85 bp, Homo sapiens; identical to SEQ ID NO: 3212
  chr8:23572524-23572609
  hyper

SEQ ID NO: 9429 - DNA, 46 bp, Homo sapiens; identical to SEQ ID NO: 3213
  chr8:23583971-23584017
  hyper

SEQ ID NO: 9430 - DNA, 308 bp, Homo sapiens; identical to SEQ ID NO: 3214
  chr8:23584093-23584401
  hyper

SEQ ID NO: 9431 - DNA, 193 bp, Homo sapiens; identical to SEQ ID NO: 3215
  chr8:23584581-23584774
  hyper

SEQ ID NO: 9432 - DNA, 69 bp, Homo sapiens
  chr8:24770293-24770362
  hyper
gggtgacaagccccccgggtggctgcacctcccactcgccgacctgggcgctgtccttggtgctgccgg

SEQ ID NO: 9433 - DNA, 117 bp, Homo sapiens
  chr8:24770413-24770530
  hyper
cgtcccccaaacgttaaaaacgccatatcccactttttatacaaataactaccccggcctgttctctttgtccccttcccgaagccttcaggcagaccgttccgcaaagtctttttt

SEQ ID NO: 9434 - DNA, 213 bp, Homo sapiens; identical to SEQ ID NO: 3216
  chr8:24770912-24771125
  hyper

SEQ ID NO: 9435 - DNA, 213 bp, Homo sapiens; identical to SEQ ID NO: 3217
  chr8:24771349-24771562
  hyper

SEQ ID NO: 9436 - DNA, 276 bp, Homo sapiens; identical to SEQ ID NO: 3218
  chr8:24813188-24813464
  hyper

SEQ ID NO: 9437 - DNA, 276 bp, Homo sapiens; identical to SEQ ID NO: 3219
  chr8:24813618-24813894
  hyper

SEQ ID NO: 9438 - DNA, 418 bp, Homo sapiens; identical to SEQ ID NO: 3220
  chr8:24814010-24814428
  hyper

SEQ ID NO: 9439 - DNA, 108 bp, Homo sapiens
  chr8:24815208-24815316
  hyper
ctggggaggagaactcggcacccaggcttcttcaggaacggatagaaaatagccatagccgcgtgactcttcccccgatacaatgtaataacccgaaaacagatgcag

SEQ ID NO: 9440 - DNA, 414 bp, Homo sapiens
  chr8:24857626-24858040
  hyper
gtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 9441 - DNA, 57 bp, Homo sapiens
  chr8:24858336-24858393
  hyper
attggcgggttagcccgggcgcagcgccctcttcccagctcccgcacccccagggct

SEQ ID NO: 9442 - DNA, 514 bp, Homo sapiens; identical to SEQ ID NO: 764
  chr8:24858647-24859161
  hyper

SEQ ID NO: 9443 - DNA, 30 bp, Homo sapiens
  chr8:24859496-24859526
  hyper
tccactttttcacttcgatctaattggtct

SEQ ID NO: 9444 - DNA, 276 bp, Homo sapiens; identical to SEQ ID NO: 3222
  chr8:25900417-25900693
  hyper

SEQ ID NO: 9445 - DNA, 237 bp, Homo sapiens; identical to SEQ ID NO: 3223
  chr8:25900780-25901017
  hyper

SEQ ID NO: 9446 - DNA, 178 bp, Homo sapiens; identical to SEQ ID NO: 3224
  chr8:25901018-25901196
  hyper

SEQ ID NO: 9447 - DNA, 307 bp, Homo sapiens
  chr8:25901540-25901847
  hyper
gcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtgg

SEQ ID NO: 9448 - DNA, 63 bp, Homo sapiens
  chr8:25902113-25902176
  hyper
cgcgcagggcctgggcgacagatggggggacagggagagagaaaggcacggggtgcgcggggg

SEQ ID NO: 9449 - DNA, 66 bp, Homo sapiens
  chr8:25903788-25903854
  hyper
tggcagcagcctcaccgaacagctgaaaccctagacggttttttaactgcgcggggctgctcgcgg

SEQ ID NO: 9450 - DNA, 191 bp, Homo sapiens
  chr8:25904157-25904348
  hyper
ttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcggg

SEQ ID NO: 9451 - DNA, 318 bp, Homo sapiens
  chr8:25905311-25905629
  hyper
ggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 9452 - DNA, 105 bp, Homo sapiens
  chr8:25905695-25905800
  hyper
cgatctcgtgcaacacaaaacctgccccgagctgtgcgggggcctggcaagcgcagctgcggccccgggaagcccaatcccgcgggactgcggagcccacgcgct

SEQ ID NO: 9453 - DNA, 38 bp, Homo sapiens
  chr8:25907271-25907309
  hyper
tgtcatcactatttacggtgcagcgatcagggcaagtt

SEQ ID NO: 9454 - DNA, 62 bp, Homo sapiens
  chr8:25909197-25909259
  hyper
gcacagggactggatcgctcagtgggtgataagctttttgtttgttccgcatggaattgcat

SEQ ID NO: 9455 - DNA, 45 bp, Homo sapiens
  chr8:26372863-26372908
  hyper
aataagtgtctcagccggggcttcacagagcgctccccaaaccgc

SEQ ID NO: 9456 - DNA, 44 bp, Homo sapiens
  chr8:26723005-26723049
  hyper
gcgctacaggttgggcgctgctcctggcccgcagttacctacat

SEQ ID NO: 9457 - DNA, 406 bp, Homo sapiens
  chr8:26723674-26724080
  hyper
gcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggca

SEQ ID NO: 9458 - DNA, 50 bp, Homo sapiens
  chr8:26724529-26724579
  hyper
gctcttctctggaggcggagaggggaccgtgtctccgaggcaccaaatcc

SEQ ID NO: 9459 - DNA, 340 bp, Homo sapiens
  chr8:30769317-30769657
  hyper
aaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcaccta

SEQ ID NO: 9460 - DNA, 34 bp, Homo sapiens
  chr8:31496785-31496819
  hyper
ctgcagcctgtttgccgcccgtcctcccattgca

SEQ ID NO: 9461 - DNA, 56 bp, Homo sapiens
  chr8:31497468-31497524
  hyper
cgacagccagaagcccgcacgcacctcgcaccatgagatggcgacgcgccccgcgc

SEQ ID NO: 9462 - DNA, 211 bp, Homo sapiens
  chr8:31497750-31497961
  hyper
agggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 9463 - DNA, 135 bp, Homo sapiens
  chr8:32404798-32404933
  hyper
aaggagtaggtttcacgcgcagttctgagtaaagtttgaatctgagaaaccccacattcacgaattaaggatctccagttctgtgtctttattctacccctccctgcctgcttttccactcggcagaactgagtg

SEQ ID NO: 9464 - DNA, 37 bp, Homo sapiens
  chr8:32405476-32405513
  hyper
ggctgcggaggggagcgggcagcgagagcctcgggtc

SEQ ID NO: 9465 - DNA, 396 bp, Homo sapiens
  chr8:32406532-32406928
  hyper
cctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 9466 - DNA, 53 bp, Homo sapiens
  chr8:32406929-32406982
  hyper
gagactcaagagcagcggcagggattcctaaaggtcagcgaagcagatgaaat

SEQ ID NO: 9467 - DNA, 176 bp, Homo sapiens
  chr8:33371806-33371982
  hyper
gcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcat

SEQ ID NO: 9468 - DNA, 237 bp, Homo sapiens
  chr8:33457142-33457379
  hyper
agccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaa

SEQ ID NO: 9469 - DNA, 43 bp, Homo sapiens
  chr8:35093236-35093279
  hyper
tcgccgaccctttcccgggctcccggagcgtgaagaagagccg

SEQ ID NO: 9470 - DNA, 23 bp, Homo sapiens
  chr8:35093951-35093974
  hyper
gccagccctggagctcgggagag

SEQ ID NO: 9471 - DNA, 193 bp, Homo sapiens; identical to SEQ ID NO: 765
  chr8:37655798-37655991
  hyper

SEQ ID NO: 9472 - DNA, 148 bp, Homo sapiens; identical to SEQ ID NO: 766
  chr8:37656049-37656197
  hyper

SEQ ID NO: 9473 - DNA, 415 bp, Homo sapiens; identical to SEQ ID NO: 767
  chr8:37822994-37823409
  hyper

SEQ ID NO: 9474 - DNA, 13 bp, Homo sapiens
  chr8:37823410-37823423
  hyper
ggttggagtggca

SEQ ID NO: 9475 - DNA, 389 bp, Homo sapiens; identical to SEQ ID NO: 769
  chr8:38008209-38008598
  hyper

SEQ ID NO: 9476 - DNA, 158 bp, Homo sapiens
  chr8:38323407-38323565
  hyper
tcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggacc

SEQ ID NO: 9477 - DNA, 355 bp, Homo sapiens
  chr8:38323800-38324155
  hyper
cagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 9478 - DNA, 26 bp, Homo sapiens
  chr8:41165893-41165919
  hyper
cagagctgccgctcccgggccagccc

SEQ ID NO: 9479 - DNA, 152 bp, Homo sapiens; identical to SEQ ID NO: 3231
  chr8:41166000-41166152
  hyper

SEQ ID NO: 9480 - DNA, 414 bp, Homo sapiens; identical to SEQ ID NO: 3232
  chr8:41166266-41166680
  hyper

SEQ ID NO: 9481 - DNA, 244 bp, Homo sapiens; identical to SEQ ID NO: 3233
  chr8:41166745-41166989
  hyper

SEQ ID NO: 9482 - DNA, 98 bp, Homo sapiens; identical to SEQ ID NO: 3234
  chr8:41167025-41167123
  hyper

SEQ ID NO: 9483 - DNA, 82 bp, Homo sapiens
  chr8:41424760-41424842
  hyper
ccacctgacccccagcgacccaagaagcaagttgtgtttgcagacgcaaaggggctgtcgttggtatcggtgcactggtttg

SEQ ID NO: 9484 - DNA, 378 bp, Homo sapiens
  chr8:41503901-41504279
  hyper
ggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcc

SEQ ID NO: 9485 - DNA, 11 bp, Homo sapiens
  chr8:41624550-41624561
  hyper
ctccacgctcc

SEQ ID NO: 9486 - DNA, 103 bp, Homo sapiens
  chr8:41624633-41624736
  hyper
cgcagccttcaggccagaggaattttcctctggatcctgctagaagcctcggcagcagaagggcagccccagcgcgcgcacccgcacccgccggggaaagttg

SEQ ID NO: 9487 - DNA, 54 bp, Homo sapiens
  chr8:41625007-41625061
  hyper
caggcgccctccactcgccccggcccggccctggccctgcgctctcccgcccgc

SEQ ID NO: 9488 - DNA, 144 bp, Homo sapiens
  chr8:41686308-41686452
  hyper
cctgaagattttccacgcgaaagtgctggggagagagttgggcctgggaggctgcgccttcttcccgcgaatcccgaaaactgcgcggcaaaggcgggttccgcagaagtcgcgcgtgacccggggcgccgccctcctcggggc

SEQ ID NO: 9489 - DNA, 205 bp, Homo sapiens
  chr8:41733449-41733654
  hyper
ccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcgg

SEQ ID NO: 9490 - DNA, 92 bp, Homo sapiens
  chr8:41733684-41733776
  hyper
cggcgctccccaggcgggcgcggggacggccctgtctggcctcaccagcacgtggggcgctgcctgcgctccagccgcggcaccctggcacc

SEQ ID NO: 9491 - DNA, 428 bp, Homo sapiens; identical to SEQ ID NO: 3235
  chr8:41753325-41753753
  hyper

SEQ ID NO: 9492 - DNA, 411 bp, Homo sapiens; identical to SEQ ID NO: 3236
  chr8:41753770-41754181
  hyper

SEQ ID NO: 9493 - DNA, 1026 bp, Homo sapiens; identical to SEQ ID NO: 3237
  chr8:41754182-41755208
  hyper

SEQ ID NO: 9494 - DNA, 40 bp, Homo sapiens
  chr8:42009967-42010007
  hyper
attgtggagggtgggcgccctgccgcggcccagtggggct

SEQ ID NO: 9495 - DNA, 36 bp, Homo sapiens
  chr8:43102519-43102555
  hyper
aagccgggacttgtacgcccgcgacaggaaagacag

SEQ ID NO: 9496 - DNA, 194 bp, Homo sapiens
  chr8:48100201-48100395
  hyper
cacagtccctgggtccgggagccagagcagcgccactcggagacgggatggttccgtgggttgtgtaggagcacaggaaagcggaggccgggccacacagcaccgcgaacccagcagcccaagcccagcggaccaagcagccacccccgggagccgccactgcctggagcagtcaccggcgggagcctccattt

SEQ ID NO: 9497 - DNA, 140 bp, Homo sapiens; identical to SEQ ID NO: 3238
  chr8:49293385-49293525
  hyper

SEQ ID NO: 9498 - DNA, 37 bp, Homo sapiens; identical to SEQ ID NO: 3239
  chr8:49293580-49293617
  hyper

SEQ ID NO: 9499 - DNA, 160 bp, Homo sapiens; identical to SEQ ID NO: 770
  chr8:49468668-49468828
  hyper

SEQ ID NO: 9500 - DNA, 362 bp, Homo sapiens; identical to SEQ ID NO: 771
  chr8:49468829-49469191
  hyper

SEQ ID NO: 9501 - DNA, 34 bp, Homo sapiens
  chr8:49647817-49647851
  hyper
ctcagttactgatctcgtgcgcggccctaacaga

SEQ ID NO: 9502 - DNA, 189 bp, Homo sapiens
  chr8:49782697-49782886
  hyper
taaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccggg

SEQ ID NO: 9503 - DNA, 30 bp, Homo sapiens
  chr8:49834319-49834349
  hyper
cggggacacagtgtccgccaggagaaggaa

SEQ ID NO: 9504 - DNA, 30 bp, Homo sapiens
  chr8:49834685-49834715
  hyper
taaaggcaggctgatcggaagaactggaag

SEQ ID NO: 9505 - DNA, 154 bp, Homo sapiens
  chr8:50822179-50822333
  hyper
tggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgc

SEQ ID NO: 9506 - DNA, 30 bp, Homo sapiens
  chr8:50822561-50822591
  hyper
tgccgcctcctcgcccgtcccccgcgcgcg

SEQ ID NO: 9507 - DNA, 36 bp, Homo sapiens
  chr8:50823108-50823144
  hyper
actggcgtctgcacccgttgccgagtgtgggtggct

SEQ ID NO: 9508 - DNA, 35 bp, Homo sapiens
  chr8:50823452-50823487
  hyper
agcctaggctgtgggcgactcgctagcactgccct

SEQ ID NO: 9509 - DNA, 15 bp, Homo sapiens
  chr8:50824293-50824308
  hyper
ctgcagccacaggga

SEQ ID NO: 9510 - DNA, 20 bp, Homo sapiens
  chr8:50824352-50824372
  hyper
cgccacgggcagctgggcta

SEQ ID NO: 9511 - DNA, 49 bp, Homo sapiens
  chr8:53477121-53477170
  hyper
gccagtaacataagccgccgcctgctgaaactggcgcttcctcagccac

SEQ ID NO: 9512 - DNA, 288 bp, Homo sapiens; identical to SEQ ID NO: 3242
  chr8:53477449-53477737
  hyper

SEQ ID NO: 9513 - DNA, 150 bp, Homo sapiens; identical to SEQ ID NO: 3243
  chr8:53478480-53478630
  hyper

SEQ ID NO: 9514 - DNA, 30 bp, Homo sapiens
  chr8:53853779-53853809
  hyper
ccctgctgccccacccgagccctggcagtc

SEQ ID NO: 9515 - DNA, 123 bp, Homo sapiens; identical to SEQ ID NO: 3244
  chr8:53854249-53854372
  hyper

SEQ ID NO: 9516 - DNA, 154 bp, Homo sapiens
  chr8:54163673-54163827
  hyper
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagag

SEQ ID NO: 9517 - DNA, 8 bp, Homo sapiens
  chr8:54164119-54164127
  hyper
cccggccc

SEQ ID NO: 9518 - DNA, 53 bp, Homo sapiens
  chr8:54789257-54789310
  hyper
cctaactggagaagccgctgggtcccgcgccaggctcgcggtggcttcagagt

SEQ ID NO: 9519 - DNA, 193 bp, Homo sapiens; identical to SEQ ID NO: 772
  chr8:54789613-54789806
  hyper

SEQ ID NO: 9520 - DNA, 588 bp, Homo sapiens; identical to SEQ ID NO: 773
  chr8:54790022-54790610
  hyper

SEQ ID NO: 9521 - DNA, 49 bp, Homo sapiens; identical to SEQ ID NO: 774
  chr8:54791897-54791946
  hyper

SEQ ID NO: 9522 - DNA, 487 bp, Homo sapiens; identical to SEQ ID NO: 775
  chr8:54792184-54792671
  hyper

SEQ ID NO: 9523 - DNA, 427 bp, Homo sapiens; identical to SEQ ID NO: 776
  chr8:54792701-54793128
  hyper

SEQ ID NO: 9524 - DNA, 161 bp, Homo sapiens
  chr8:54793349-54793510
  hyper
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtga

SEQ ID NO: 9525 - DNA, 126 bp, Homo sapiens
  chr8:54793756-54793882
  hyper
gtgtcgccgttgctgcggggcgggagccggtgcgagtcgggggttccttcccgcagtgcgagtttgggggagtggggctgcgagtgcgtccgcgtgcgaagaggggcatcgcgccaccaggatcaa

SEQ ID NO: 9526 - DNA, 217 bp, Homo sapiens
  chr8:54794167-54794384
  hyper
ccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatctt

SEQ ID NO: 9527 - DNA, 134 bp, Homo sapiens
  chr8:54794647-54794781
  hyper
tccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 9528 - DNA, 124 bp, Homo sapiens
  chr8:54794826-54794950
  hyper
cgcttgtgggggagtgagtggggaaggggctttgggagaggcggcgcgcgggcactgaggtgcatcgtgagcttcccggacttgacagcatcaaaggaaaatcctggcgagcagccagggccag

SEQ ID NO: 9529 - DNA, 23 bp, Homo sapiens
  chr8:54795139-54795162
  hyper
cgtaacttggcaaaagctcgcgc

SEQ ID NO: 9530 - DNA, 203 bp, Homo sapiens; identical to SEQ ID NO: 3250
  chr8:55366165-55366368
  hyper

SEQ ID NO: 9531 - DNA, 562 bp, Homo sapiens; identical to SEQ ID NO: 3251
  chr8:55367063-55367625
  hyper

SEQ ID NO: 9532 - DNA, 223 bp, Homo sapiens; identical to SEQ ID NO: 777
  chr8:55370113-55370336
  hyper

SEQ ID NO: 9533 - DNA, 86 bp, Homo sapiens; identical to SEQ ID NO: 778
  chr8:55370337-55370423
  hyper

SEQ ID NO: 9534 - DNA, 9 bp, Homo sapiens
  chr8:55370424-55370433
  hyper
ggaccggcc

SEQ ID NO: 9535 - DNA, 109 bp, Homo sapiens; identical to SEQ ID NO: 780
  chr8:55370567-55370676
  hyper

SEQ ID NO: 9536 - DNA, 204 bp, Homo sapiens; identical to SEQ ID NO: 781
  chr8:55371172-55371376
  hyper

SEQ ID NO: 9537 - DNA, 286 bp, Homo sapiens; identical to SEQ ID NO: 782
  chr8:55371439-55371725
  hyper

SEQ ID NO: 9538 - DNA, 75 bp, Homo sapiens; identical to SEQ ID NO: 783
  chr8:55371993-55372068
  hyper

SEQ ID NO: 9539 - DNA, 60 bp, Homo sapiens; identical to SEQ ID NO: 784
  chr8:55372416-55372476
  hyper

SEQ ID NO: 9540 - DNA, 29 bp, Homo sapiens
  chr8:55379202-55379231
  hyper
ctcttagcttggtgccggggcccgcccgg

SEQ ID NO: 9541 - DNA, 162 bp, Homo sapiens; identical to SEQ ID NO: 3261
  chr8:55379295-55379457
  hyper

SEQ ID NO: 9542 - DNA, 108 bp, Homo sapiens; identical to SEQ ID NO: 3262
  chr8:55380036-55380144
  hyper

SEQ ID NO: 9543 - DNA, 14 bp, Homo sapiens
  chr8:55383182-55383196
  hyper
ggtgccgacttcaa

SEQ ID NO: 9544 - DNA, 206 bp, Homo sapiens
  chr8:56013657-56013863
  hyper
gcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagg

SEQ ID NO: 9545 - DNA, 54 bp, Homo sapiens; identical to SEQ ID NO: 3263
  chr8:56014131-56014185
  hyper

SEQ ID NO: 9546 - DNA, 368 bp, Homo sapiens; identical to SEQ ID NO: 3264
  chr8:56014376-56014744
  hyper

SEQ ID NO: 9547 - DNA, 19 bp, Homo sapiens
  chr8:56015034-56015053
  hyper
ggtgtggaggcatcatggc

SEQ ID NO: 9548 - DNA, 161 bp, Homo sapiens; identical to SEQ ID NO: 786
  chr8:56015185-56015346
  hyper

SEQ ID NO: 9549 - DNA, 67 bp, Homo sapiens; identical to SEQ ID NO: 787
  chr8:56015565-56015632
  hyper

SEQ ID NO: 9550 - DNA, 181 bp, Homo sapiens; identical to SEQ ID NO: 3268
  chr8:57026141-57026322
  hyper

SEQ ID NO: 9551 - DNA, 55 bp, Homo sapiens; identical to SEQ ID NO: 3269
  chr8:57026501-57026556
  hyper

SEQ ID NO: 9552 - DNA, 148 bp, Homo sapiens; identical to SEQ ID NO: 788
  chr8:57069590-57069738
  hyper

SEQ ID NO: 9553 - DNA, 163 bp, Homo sapiens; identical to SEQ ID NO: 789
  chr8:57069850-57070013
  hyper

SEQ ID NO: 9554 - DNA, 143 bp, Homo sapiens; identical to SEQ ID NO: 790
  chr8:57070014-57070157
  hyper

SEQ ID NO: 9555 - DNA, 180 bp, Homo sapiens
  chr8:57232591-57232771
  hyper
caggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggc

SEQ ID NO: 9556 - DNA, 286 bp, Homo sapiens; identical to SEQ ID NO: 791
  chr8:57358806-57359092
  hyper

SEQ ID NO: 9557 - DNA, 400 bp, Homo sapiens; identical to SEQ ID NO: 792
  chr8:57359259-57359659
  hyper

SEQ ID NO: 9558 - DNA, 86 bp, Homo sapiens; identical to SEQ ID NO: 793
  chr8:57360540-57360626
  hyper

SEQ ID NO: 9559 - DNA, 37 bp, Homo sapiens; identical to SEQ ID NO: 794
  chr8:57360769-57360806
  hyper

SEQ ID NO: 9560 - DNA, 29 bp, Homo sapiens
  chr8:58907390-58907419
  hyper
agagagactgctgggcgggggttgggatt

SEQ ID NO: 9561 - DNA, 338 bp, Homo sapiens
  chr8:58907483-58907821
  hyper
cgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccggggttggagccagggcggggggaagctggccgcgctgcggagcggaggtgggctccgaaagcgcgccgccggttgctgctggaggagtgggactacgaaggatggggactccgctcggccacc

SEQ ID NO: 9562 - DNA, 119 bp, Homo sapiens
  chr8:58907822-58907941
  hyper
ctcctgaatggtctctaatctcggtgttaaatactttatgagagtatcaataccacctaatcctttgctgagaattactgctagaaatgtagattctgaggttccgaaagtttgttttt

SEQ ID NO: 9563 - DNA, 37 bp, Homo sapiens
  chr8:60030268-60030305
  hyper
tcccgtggaatgcaccgagggtcgccatggatgtgcc

SEQ ID NO: 9564 - DNA, 71 bp, Homo sapiens
  chr8:60030539-60030610
  hyper
agtaaccccctccctcgtaccccctgactgtcctataggtggacccagccgaactccgcagcagcccaggc

SEQ ID NO: 9565 - DNA, 65 bp, Homo sapiens
  chr8:60030824-60030889
  hyper
ttgacccagctaccccgctgtgctctggcccgcggacctgtgtccgaacccgggctcggctgccg

SEQ ID NO: 9566 - DNA, 61 bp, Homo sapiens
  chr8:60031205-60031266
  hyper
aggaaggaaagaatccgagcaaatcgtgtcactttccgcacaatcgcggtgtttggcaagc

SEQ ID NO: 9567 - DNA, 75 bp, Homo sapiens
  chr8:60031479-60031554
  hyper
gtcccagacagggagcgtcgggcgcagcggcgggctgggctggaggtggataaaatcttacgtccatttcactct

SEQ ID NO: 9568 - DNA, 89 bp, Homo sapiens
  chr8:60032140-60032229
  hyper
ccagaggccggggaccggagaaaggaggagcggagaaggagaaggaggagagcacggcctggctgggacagaagcggtgggaccctggg

SEQ ID NO: 9569 - DNA, 231 bp, Homo sapiens
  chr8:60032490-60032721
  hyper
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgaga

SEQ ID NO: 9570 - DNA, 391 bp, Homo sapiens
  chr8:61193203-61193594
  hyper
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactc

SEQ ID NO: 9571 - DNA, 46 bp, Homo sapiens
  chr8:62200760-62200806
  hyper
tcgatgccatggctgcggcgtttcagcacttcggtatgtggacagc

SEQ ID NO: 9572 - DNA, 171 bp, Homo sapiens
  chr8:63160730-63160901
  hyper
gggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcc

SEQ ID NO: 9573 - DNA, 57 bp, Homo sapiens
  chr8:63161631-63161688
  hyper
catgggctgctgcaccggacgctgctcgctcatctgcctctgcgcgctgcagttggt

SEQ ID NO: 9574 - DNA, 32 bp, Homo sapiens
  chr8:63998517-63998549
  hyper
agagtggtccggtagcgcgttgagctgcggcc

SEQ ID NO: 9575 - DNA, 82 bp, Homo sapiens
  chr8:65281329-65281411
  hyper
ggggcctctggtcagcgctgattaataagtgttttttgttgtgaagtgttgaataatagaggatggccggtgacccagtaag

SEQ ID NO: 9576 - DNA, 30 bp, Homo sapiens
  chr8:65281704-65281734
  hyper
agtttcgcgcttgttcgaccaacaccagtg

SEQ ID NO: 9577 - DNA, 109 bp, Homo sapiens; identical to SEQ ID NO: 3277
  chr8:65282332-65282441
  hyper

SEQ ID NO: 9578 - DNA, 221 bp, Homo sapiens
  chr8:65283860-65284081
  hyper
accagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccg

SEQ ID NO: 9579 - DNA, 154 bp, Homo sapiens
  chr8:65286558-65286712
  hyper
cctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgag

SEQ ID NO: 9580 - DNA, 170 bp, Homo sapiens; identical to SEQ ID NO: 3278
  chr8:65286942-65287112
  hyper

SEQ ID NO: 9581 - DNA, 304 bp, Homo sapiens
  chr8:65289049-65289353
  hyper
tttagttttagacaacgtattcaaagtacttgagaagaatatgcaatgacattttttccgtgtcctaatcaggaccatggtgaggtccccgtggttcaccgagtggtggtccagggctctggttgggacgctgagttaggttggcaaagcgtcattgttttgaaaggcacattcgtccggaatggcattcgtgataagattaaacataaacctaaaccttggcctcgggggaaggcaggctgcggggttgagaagaggagatgcagattagctctgcttttgctgcttgcgcacataattaaga

SEQ ID NO: 9582 - DNA, 724 bp, Homo sapiens; identical to SEQ ID NO: 3279
  chr8:65289592-65290316
  hyper

SEQ ID NO: 9583 - DNA, 27 bp, Homo sapiens
  chr8:65290655-65290682
  hyper
tctctctcctttcctcggactctggag

SEQ ID NO: 9584 - DNA, 30 bp, Homo sapiens
  chr8:65291052-65291082
  hyper
atgagttaatttttccgcattacaaagaaa

SEQ ID NO: 9585 - DNA, 30 bp, Homo sapiens
  chr8:65291776-65291806
  hyper
ggtgaatgccaagagcggagcctacggctg

SEQ ID NO: 9586 - DNA, 86 bp, Homo sapiens
  chr8:65292608-65292694
  hyper
atgcaccaaagtagccgcgccctccctgcctggcgctgtccgcggtgctgaccgtggcccttttctctctccgtaatcaaactgga

SEQ ID NO: 9587 - DNA, 51 bp, Homo sapiens; identical to SEQ ID NO: 3280
  chr8:65488271-65488322
  hyper

SEQ ID NO: 9588 - DNA, 30 bp, Homo sapiens
  chr8:65489099-65489129
  hyper
ggctctcagtggattcgcttttccagagct

SEQ ID NO: 9589 - DNA, 84 bp, Homo sapiens; identical to SEQ ID NO: 3281
  chr8:65492776-65492860
  hyper

SEQ ID NO: 9590 - DNA, 384 bp, Homo sapiens; identical to SEQ ID NO: 3282
  chr8:65493195-65493579
  hyper

SEQ ID NO: 9591 - DNA, 149 bp, Homo sapiens; identical to SEQ ID NO: 3283
  chr8:65493806-65493955
  hyper

SEQ ID NO: 9592 - DNA, 25 bp, Homo sapiens
  chr8:65494076-65494101
  hyper
cggcttaacatcaatgcccgagagc

SEQ ID NO: 9593 - DNA, 91 bp, Homo sapiens; identical to SEQ ID NO: 3285
  chr8:65494102-65494193
  hyper

SEQ ID NO: 9594 - DNA, 82 bp, Homo sapiens
  chr8:65498500-65498582
  hyper
gcaaatgatcatcttcgatagagctctctagttacccgtgcttctccctccctatggtatgtgtttgtgtgtgtgtgtgtgc

SEQ ID NO: 9595 - DNA, 22 bp, Homo sapiens
  chr8:65498642-65498664
  hyper
cagtccccgcagctgggcaacc

SEQ ID NO: 9596 - DNA, 173 bp, Homo sapiens; identical to SEQ ID NO: 3286
  chr8:65499750-65499923
  hyper

SEQ ID NO: 9597 - DNA, 30 bp, Homo sapiens
  chr8:67089781-67089811
  hyper
gagttggttagagttcgctcagctgggagg

SEQ ID NO: 9598 - DNA, 128 bp, Homo sapiens
  chr8:67344533-67344661
  hyper
caagggtggatggtgcgagcgccgctggggcagctggcgttctggttcttactccgtgggaaaatggccctgagcccgactggcttgaggcttagacaggtgaccccgcgaagcgggtgggcaggcgc

SEQ ID NO: 9599 - DNA, 95 bp, Homo sapiens; identical to SEQ ID NO: 795
  chr8:67873327-67873422
  hyper

SEQ ID NO: 9600 - DNA, 1 bp, Homo sapiens
  chr8:67873798-67873799
  hyper
c

SEQ ID NO: 9601 - DNA, 251 bp, Homo sapiens; identical to SEQ ID NO: 797
  chr8:67873800-67874051
  hyper

SEQ ID NO: 9602 - DNA, 509 bp, Homo sapiens; identical to SEQ ID NO: 798
  chr8:67874164-67874673
  hyper

SEQ ID NO: 9603 - DNA, 103 bp, Homo sapiens; identical to SEQ ID NO: 799
  chr8:67874755-67874858
  hyper

SEQ ID NO: 9604 - DNA, 402 bp, Homo sapiens; identical to SEQ ID NO: 800
  chr8:67874859-67875261
  hyper

SEQ ID NO: 9605 - DNA, 179 bp, Homo sapiens; identical to SEQ ID NO: 801
  chr8:67875262-67875441
  hyper

SEQ ID NO: 9606 - DNA, 240 bp, Homo sapiens; identical to SEQ ID NO: 802
  chr8:67875442-67875682
  hyper

SEQ ID NO: 9607 - DNA, 159 bp, Homo sapiens; identical to SEQ ID NO: 3295
  chr8:67940805-67940964
  hyper

SEQ ID NO: 9608 - DNA, 258 bp, Homo sapiens; identical to SEQ ID NO: 3296
  chr8:68864545-68864803
  hyper

SEQ ID NO: 9609 - DNA, 37 bp, Homo sapiens
  chr8:68865398-68865435
  hyper
caattccctcccccccgccccccgccccggcttaaat

SEQ ID NO: 9610 - DNA, 61 bp, Homo sapiens
  chr8:69242905-69242966
  hyper
cattggctttttaagcggcgctgtcgctagggagcggctggtagggcgagcagcctcgggg

SEQ ID NO: 9611 - DNA, 202 bp, Homo sapiens; identical to SEQ ID NO: 3297
  chr8:69243284-69243486
  hyper

SEQ ID NO: 9612 - DNA, 329 bp, Homo sapiens; identical to SEQ ID NO: 3298
  chr8:69243487-69243816
  hyper

SEQ ID NO: 9613 - DNA, 49 bp, Homo sapiens
  chr8:69244461-69244510
  hyper
tgagcaggggtggggcgtgcggaccgtagtcagaagtggaggcccttgc

SEQ ID NO: 9614 - DNA, 125 bp, Homo sapiens
  chr8:69244511-69244636
  hyper
gagggactcccttggtcccatccagttcagggggcactgaccggcggcgagagttcgcgggagggtcgaggtgctcccgccttgcccccgccttgcccccgccttgcccccgccccccacgtctc

SEQ ID NO: 9615 - DNA, 34 bp, Homo sapiens
  chr8:70404830-70404864
  hyper
cgccgccgtccaagccggccggctgcagcgcagt

SEQ ID NO: 9616 - DNA, 356 bp, Homo sapiens
  chr8:70744839-70745195
  hyper
agcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttga

SEQ ID NO: 9617 - DNA, 30 bp, Homo sapiens
  chr8:70945287-70945317
  hyper
ggtcccactcatctgcgccaggtggagggg

SEQ ID NO: 9618 - DNA, 71 bp, Homo sapiens; identical to SEQ ID NO: 3299
  chr8:70946844-70946915
  hyper

SEQ ID NO: 9619 - DNA, 568 bp, Homo sapiens; identical to SEQ ID NO: 3300
  chr8:70947090-70947658
  hyper

SEQ ID NO: 9620 - DNA, 23 bp, Homo sapiens
  chr8:70982262-70982285
  hyper
cgctcccacaattaagacaaaac

SEQ ID NO: 9621 - DNA, 281 bp, Homo sapiens; identical to SEQ ID NO: 804
  chr8:70982286-70982567
  hyper

SEQ ID NO: 9622 - DNA, 397 bp, Homo sapiens; identical to SEQ ID NO: 805
  chr8:70982850-70983247
  hyper

SEQ ID NO: 9623 - DNA, 302 bp, Homo sapiens; identical to SEQ ID NO: 806
  chr8:70983568-70983870
  hyper

SEQ ID NO: 9624 - DNA, 277 bp, Homo sapiens; identical to SEQ ID NO: 807
  chr8:70984016-70984293
  hyper

SEQ ID NO: 9625 - DNA, 319 bp, Homo sapiens; identical to SEQ ID NO: 808
  chr8:70984343-70984662
  hyper

SEQ ID NO: 9626 - DNA, 250 bp, Homo sapiens; identical to SEQ ID NO: 809
  chr8:70984744-70984994
  hyper

SEQ ID NO: 9627 - DNA, 168 bp, Homo sapiens
  chr8:72273966-72274134
  hyper
gctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaa

SEQ ID NO: 9628 - DNA, 78 bp, Homo sapiens; identical to SEQ ID NO: 810
  chr8:72460433-72460511
  hyper

SEQ ID NO: 9629 - DNA, 557 bp, Homo sapiens; identical to SEQ ID NO: 3309
  chr8:72468582-72469139
  hyper

SEQ ID NO: 9630 - DNA, 54 bp, Homo sapiens
  chr8:72469478-72469532
  hyper
ggccacagcaagagtcgccgggtgaggacgggcccggcccgtggcgcctagctg

SEQ ID NO: 9631 - DNA, 119 bp, Homo sapiens
  chr8:72754490-72754609
  hyper
cgcgaaaggccggggctgtgtggaaccgtcccgcacgtgtgcgatgaatctggctccgctgagaacggatccgtgggctgtctggcgcgggctggggcagcagccgagagttagtctac

SEQ ID NO: 9632 - DNA, 441 bp, Homo sapiens
  chr8:72754821-72755262
  hyper
gctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttc

SEQ ID NO: 9633 - DNA, 345 bp, Homo sapiens; identical to SEQ ID NO: 811
  chr8:72755470-72755815
  hyper

SEQ ID NO: 9634 - DNA, 157 bp, Homo sapiens; identical to SEQ ID NO: 812
  chr8:72756655-72756812
  hyper

SEQ ID NO: 9635 - DNA, 83 bp, Homo sapiens; identical to SEQ ID NO: 813
  chr8:72756813-72756896
  hyper

SEQ ID NO: 9636 - DNA, 316 bp, Homo sapiens; identical to SEQ ID NO: 3313
  chr8:72987600-72987916
  hyper

SEQ ID NO: 9637 - DNA, 119 bp, Homo sapiens; identical to SEQ ID NO: 3314
  chr8:72987917-72988036
  hyper

SEQ ID NO: 9638 - DNA, 15 bp, Homo sapiens
  chr8:73163646-73163661
  hyper
ccggacttcagaacc

SEQ ID NO: 9639 - DNA, 108 bp, Homo sapiens
  chr8:73163859-73163967
  hyper
cgagagagcgctgtcagccggccaggcgctggggtccgcgcgagcccgagctctccctcgctgcagctcacaggcagcgaaaatctcgctccgcgagagccctggaga

SEQ ID NO: 9640 - DNA, 46 bp, Homo sapiens
  chr8:73448786-73448832
  hyper
gtcagatcttatctgcgctcctagttatctccgcagctctttctcc

SEQ ID NO: 9641 - DNA, 153 bp, Homo sapiens; identical to SEQ ID NO: 3315
  chr8:73449802-73449955
  hyper

SEQ ID NO: 9642 - DNA, 90 bp, Homo sapiens; identical to SEQ ID NO: 3316
  chr8:73450026-73450116
  hyper

SEQ ID NO: 9643 - DNA, 39 bp, Homo sapiens
  chr8:73450520-73450559
  hyper
attcttcaagcggtgcgcggtctccgttctgtagcacga

SEQ ID NO: 9644 - DNA, 262 bp, Homo sapiens; identical to SEQ ID NO: 3317
  chr8:75896574-75896836
  hyper

SEQ ID NO: 9645 - DNA, 364 bp, Homo sapiens; identical to SEQ ID NO: 3318
  chr8:75896837-75897201
  hyper

SEQ ID NO: 9646 - DNA, 156 bp, Homo sapiens; identical to SEQ ID NO: 3319
  chr8:77585219-77585375
  hyper

SEQ ID NO: 9647 - DNA, 102 bp, Homo sapiens
  chr8:77585603-77585705
  hyper
tcacagatgcaaaggcgctgtacggtgaactttatatcgtggaaactaacttaactccgagaagagaaagtgcaattagacggcaaccgagtataagaaaat

SEQ ID NO: 9648 - DNA, 165 bp, Homo sapiens; identical to SEQ ID NO: 3320
  chr8:77586175-77586340
  hyper

SEQ ID NO: 9649 - DNA, 293 bp, Homo sapiens; identical to SEQ ID NO: 3321
  chr8:77590239-77590532
  hyper

SEQ ID NO: 9650 - DNA, 399 bp, Homo sapiens
  chr8:77593310-77593709
  hyper
gggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcac

SEQ ID NO: 9651 - DNA, 56 bp, Homo sapiens
  chr8:77594619-77594675
  hyper
agaggctggggtgaacgctggggctggggctgcaggtagacacccgcccaccggag

SEQ ID NO: 9652 - DNA, 114 bp, Homo sapiens
  chr8:77594757-77594871
  hyper
cgggatcgcccggcctctgggccagggacccgcgaggcggcggctgcttgctccgaacggaacgccgccgggtgtgcgttagaccagcggatagacgcccgcggcttggggtca

SEQ ID NO: 9653 - DNA, 46 bp, Homo sapiens
  chr8:77595339-77595385
  hyper
gagaggaggcttctgcgggcgcctttggccgcgacttctcacttcc

SEQ ID NO: 9654 - DNA, 453 bp, Homo sapiens
  chr8:79428468-79428921
  hyper
tgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctat

SEQ ID NO: 9655 - DNA, 490 bp, Homo sapiens; identical to SEQ ID NO: 3322
  chr8:80523960-80524450
  hyper

SEQ ID NO: 9656 - DNA, 463 bp, Homo sapiens
  chr8:80524845-80525308
  hyper
tgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccc

SEQ ID NO: 9657 - DNA, 39 bp, Homo sapiens
  chr8:80525530-80525569
  hyper
ctggccgggtgggggcgcacgtggcgactgggtgtgtgg

SEQ ID NO: 9658 - DNA, 164 bp, Homo sapiens; identical to SEQ ID NO: 3323
  chr8:80803593-80803757
  hyper

SEQ ID NO: 9659 - DNA, 199 bp, Homo sapiens; identical to SEQ ID NO: 3324
  chr8:81478156-81478355
  hyper

SEQ ID NO: 9660 - DNA, 448 bp, Homo sapiens
  chr8:82192848-82193296
  hyper
ctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcc

SEQ ID NO: 9661 - DNA, 30 bp, Homo sapiens
  chr8:82193521-82193551
  hyper
ttcctctgtcagccccgtctcccccaggtc

SEQ ID NO: 9662 - DNA, 94 bp, Homo sapiens
  chr8:85095574-85095668
  hyper
aggcgccaggctccccgtcgccgccgccgccgcctcgccagccagagttgggctccgtgggcttcccccctcgcagcctcggtccttccccgct

SEQ ID NO: 9663 - DNA, 141 bp, Homo sapiens
  chr8:85096583-85096724
  hyper
aaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaat

SEQ ID NO: 9664 - DNA, 41 bp, Homo sapiens
  chr8:85097179-85097220
  hyper
ccttgaggatggcaccggccctcgcacgctcaactcctgct

SEQ ID NO: 9665 - DNA, 942 bp, Homo sapiens
  chr8:89339064-89340006
  hyper
aattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgatgcacgaaatccaaccgtcttccagtgctgaatgtgagtaagatcatagtgaactgtgcttcaatggatggacgagctccccttcgttttctccctctctccctctccctccctccctcgtttcctttcaaaaaaaagtcctccgggtgggtaaggagcctgcaggttcacccacagccgggcaaggggaggagacaggggccccgcgctcggcagcccccgagaggcagcggcgaagacagggtcagcagtagttcctgttcaccatcctccggggtcagtcaccgggaacgtggcgcctaagttcaccggcggttccggctcaaagagcctagtcgcagccgcagcagcagcagccgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcgcgcgcgcgcgcacacacacacac

SEQ ID NO: 9666 - DNA, 124 bp, Homo sapiens
  chr8:89340273-89340397
  hyper
cgcatctaaaaacgagtgcgcccctctccagccatgagctgggtggggctcaggctgcggaccctagtggggcctggggagcggcccaaccctggtcctggagagcggtcggcattcctgagga

SEQ ID NO: 9667 - DNA, 30 bp, Homo sapiens
  chr8:89340928-89340958
  hyper
ggcaagagggggaggcggctggcaagaagc

SEQ ID NO: 9668 - DNA, 32 bp, Homo sapiens
  chr8:91094254-91094286
  hyper
aatccagccttctttcgcgcctgctggagctc

SEQ ID NO: 9669 - DNA, 90 bp, Homo sapiens
  chr8:91804064-91804154
  hyper
ggtgcgtccgcctagccccgctccgcctgaggccgtcagggctcccgaggatggaagattcccaggagacatcgccgtcctccaacaact

SEQ ID NO: 9670 - DNA, 448 bp, Homo sapiens; identical to SEQ ID NO: 814
  chr8:91997061-91997509
  hyper

SEQ ID NO: 9671 - DNA, 479 bp, Homo sapiens; identical to SEQ ID NO: 815
  chr8:91997527-91998006
  hyper

SEQ ID NO: 9672 - DNA, 141 bp, Homo sapiens
  chr8:93114380-93114521
  hyper
atcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctggg

SEQ ID NO: 9673 - DNA, 30 bp, Homo sapiens
  chr8:93115382-93115412
  hyper
ctgctcccctcctcccgcctccctccctcc

SEQ ID NO: 9674 - DNA, 36 bp, Homo sapiens
  chr8:93115823-93115859
  hyper
gggcggcctccctcccggcctcgccctctcccatgc

SEQ ID NO: 9675 - DNA, 202 bp, Homo sapiens; identical to SEQ ID NO: 816
  chr8:97157008-97157210
  hyper

SEQ ID NO: 9676 - DNA, 232 bp, Homo sapiens; identical to SEQ ID NO: 817
  chr8:97157666-97157898
  hyper

SEQ ID NO: 9677 - DNA, 122 bp, Homo sapiens; identical to SEQ ID NO: 818
  chr8:97158021-97158143
  hyper

SEQ ID NO: 9678 - DNA, 204 bp, Homo sapiens; identical to SEQ ID NO: 819
  chr8:97169716-97169920
  hyper

SEQ ID NO: 9679 - DNA, 13 bp, Homo sapiens
  chr8:97169921-97169934
  hyper
gaagtccttgcca

SEQ ID NO: 9680 - DNA, 180 bp, Homo sapiens; identical to SEQ ID NO: 821
  chr8:97170158-97170338
  hyper

SEQ ID NO: 9681 - DNA, 291 bp, Homo sapiens; identical to SEQ ID NO: 822
  chr8:97170377-97170668
  hyper

SEQ ID NO: 9682 - DNA, 65 bp, Homo sapiens; identical to SEQ ID NO: 3334
  chr8:97171119-97171184
  hyper

SEQ ID NO: 9683 - DNA, 361 bp, Homo sapiens; identical to SEQ ID NO: 823
  chr8:97171598-97171959
  hyper

SEQ ID NO: 9684 - DNA, 722 bp, Homo sapiens; identical to SEQ ID NO: 824
  chr8:97172018-97172740
  hyper

SEQ ID NO: 9685 - DNA, 50 bp, Homo sapiens; identical to SEQ ID NO: 825
  chr8:97172821-97172871
  hyper

SEQ ID NO: 9686 - DNA, 388 bp, Homo sapiens; identical to SEQ ID NO: 826
  chr8:97173138-97173526
  hyper

SEQ ID NO: 9687 - DNA, 13 bp, Homo sapiens
  chr8:97173527-97173540
  hyper
gtggtaccctccc

SEQ ID NO: 9688 - DNA, 30 bp, Homo sapiens
  chr8:97505645-97505675
  hyper
aaagagaaaagacaacggggaagaaaagag

SEQ ID NO: 9689 - DNA, 231 bp, Homo sapiens; identical to SEQ ID NO: 3340
  chr8:97506177-97506408
  hyper

SEQ ID NO: 9690 - DNA, 38 bp, Homo sapiens; identical to SEQ ID NO: 3341
  chr8:97506447-97506485
  hyper

SEQ ID NO: 9691 - DNA, 580 bp, Homo sapiens; identical to SEQ ID NO: 3342
  chr8:97507115-97507695
  hyper

SEQ ID NO: 9692 - DNA, 50 bp, Homo sapiens; identical to SEQ ID NO: 828
  chr8:98289818-98289868
  hyper

SEQ ID NO: 9693 - DNA, 425 bp, Homo sapiens; identical to SEQ ID NO: 829
  chr8:98289922-98290347
  hyper

SEQ ID NO: 9694 - DNA, 94 bp, Homo sapiens
  chr8:99076589-99076683
  hyper
tgccataccctccaccgtctcccctcctgtctcctgggctctactcctccctgccctcctctgcgtcctggccctcccgctctcttccgctttg

SEQ ID NO: 9695 - DNA, 240 bp, Homo sapiens
  chr8:99076759-99076999
  hyper
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcg

SEQ ID NO: 9696 - DNA, 91 bp, Homo sapiens
  chr8:99439283-99439374
  hyper
tgggtgggtgaggggcgcgcggatccggagagggggctccgggagcggcgggaccacgcagccacctgtgagccttcggcagctgcgggcg

SEQ ID NO: 9697 - DNA, 660 bp, Homo sapiens; identical to SEQ ID NO: 830
  chr8:99439694-99440354
  hyper

SEQ ID NO: 9698 - DNA, 298 bp, Homo sapiens; identical to SEQ ID NO: 831
  chr8:99951846-99952144
  hyper

SEQ ID NO: 9699 - DNA, 106 bp, Homo sapiens; identical to SEQ ID NO: 832
  chr8:99952198-99952304
  hyper

SEQ ID NO: 9700 - DNA, 319 bp, Homo sapiens; identical to SEQ ID NO: 833
  chr8:99952532-99952851
  hyper

SEQ ID NO: 9701 - DNA, 140 bp, Homo sapiens
  chr8:99954416-99954556
  hyper
tcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggc

SEQ ID NO: 9702 - DNA, 92 bp, Homo sapiens
  chr8:99955188-99955280
  hyper
aaacactcgaatctccgtttcaagctcactttttaatctttgcgaacttaaaattggaaagacagaaaaaaaatctgcgacccctgttatgt

SEQ ID NO: 9703 - DNA, 30 bp, Homo sapiens
  chr8:99960111-99960141
  hyper
tctcctggggcatcccgggtggagggatgt

SEQ ID NO: 9704 - DNA, 133 bp, Homo sapiens
  chr8:99960365-99960498
  hyper
cacttttctttcctgcggcccgtcaccgctgatagatggggctgagggcagaggaaggaaaaagaaaacctccgaggtcagtgcggggcgaggtgagcccctcccagggccctctggcccaggaggatgaagc

SEQ ID NO: 9705 - DNA, 48 bp, Homo sapiens
  chr8:99961792-99961840
  hyper
tgccacaaggccttccggaggcaagatcacctgcgggatcacaggtga

SEQ ID NO: 9706 - DNA, 178 bp, Homo sapiens; identical to SEQ ID NO: 834
  chr8:99985866-99986044
  hyper

SEQ ID NO: 9707 - DNA, 302 bp, Homo sapiens; identical to SEQ ID NO: 835
  chr8:99986225-99986527
  hyper

SEQ ID NO: 9708 - DNA, 165 bp, Homo sapiens; identical to SEQ ID NO: 836
  chr8:99986791-99986956
  hyper

SEQ ID NO: 9709 - DNA, 30 bp, Homo sapiens
  chr8:101118014-101118044
  hyper
tgggagcggggataccgctaggagggcagg

SEQ ID NO: 9710 - DNA, 133 bp, Homo sapiens; identical to SEQ ID NO: 3352
  chr8:101821973-101822106
  hyper

SEQ ID NO: 9711 - DNA, 38 bp, Homo sapiens
  chr8:102505884-102505922
  hyper
ctcggacgcggcaggcgggactgcgtggggcgcgccga

SEQ ID NO: 9712 - DNA, 174 bp, Homo sapiens
  chr8:104152775-104152949
  hyper
ctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagaggg

SEQ ID NO: 9713 - DNA, 295 bp, Homo sapiens
  chr8:104153267-104153562
  hyper
cgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagac

SEQ ID NO: 9714 - DNA, 349 bp, Homo sapiens
  chr8:104511157-104511506
  hyper
cattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccac

SEQ ID NO: 9715 - DNA, 930 bp, Homo sapiens; identical to SEQ ID NO: 3353
  chr8:104512023-104512953
  hyper

SEQ ID NO: 9716 - DNA, 504 bp, Homo sapiens; identical to SEQ ID NO: 3354
  chr8:104513405-104513909
  hyper

SEQ ID NO: 9717 - DNA, 16 bp, Homo sapiens
  chr8:104513910-104513926
  hyper
gcgagtgctaacaccc

SEQ ID NO: 9718 - DNA, 253 bp, Homo sapiens; identical to SEQ ID NO: 3356
  chr8:105235249-105235502
  hyper

SEQ ID NO: 9719 - DNA, 191 bp, Homo sapiens
  chr8:105235863-105236054
  hyper
cgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctc

SEQ ID NO: 9720 - DNA, 155 bp, Homo sapiens
  chr8:105600526-105600681
  hyper
gtggggagaagtcagcgggaagccttttcagggaatcgagtaggacaagggctggcgcggtgggaatctcgccggtgagagaacttcctaaccccgggttgagggggcggggggaaggaccgtcccggcagcggcgggggcgagctcctctgctt

SEQ ID NO: 9721 - DNA, 87 bp, Homo sapiens
  chr8:105601174-105601261
  hyper
gaagctggaggtagacgacgccgacgccgccgccgccgccgccgccgccgccgagccaccggctgctccctgcgctctccgcggctg

SEQ ID NO: 9722 - DNA, 30 bp, Homo sapiens
  chr8:105602021-105602051
  hyper
tcatttgacatctcacgctgggtcgggtgc

SEQ ID NO: 9723 - DNA, 30 bp, Homo sapiens
  chr8:106330435-106330465
  hyper
ggccctcctccaagccgtccccacgcctcc

SEQ ID NO: 9724 - DNA, 63 bp, Homo sapiens
  chr8:106331011-106331074
  hyper
cccggaggagcccagcgcccggagcacctggagtccggccggcggcgggccgagcctggccag

SEQ ID NO: 9725 - DNA, 154 bp, Homo sapiens
  chr8:106331083-106331237
  hyper
cggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttg

SEQ ID NO: 9726 - DNA, 505 bp, Homo sapiens
  chr8:107283327-107283832
  hyper
ggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcag

SEQ ID NO: 9727 - DNA, 140 bp, Homo sapiens
  chr8:107284082-107284222
  hyper
gaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 9728 - DNA, 208 bp, Homo sapiens
  chr8:109093726-109093934
  hyper
gggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctgga

SEQ ID NO: 9729 - DNA, 33 bp, Homo sapiens
  chr8:109094147-109094180
  hyper
agaaagttcccatctcgtcgcagtttccagaaa

SEQ ID NO: 9730 - DNA, 952 bp, Homo sapiens; identical to SEQ ID NO: 3357
  chr8:109094485-109095437
  hyper

SEQ ID NO: 9731 - DNA, 2 bp, Homo sapiens
  chr8:109095505-109095507
  hyper
cg

SEQ ID NO: 9732 - DNA, 139 bp, Homo sapiens
  chr8:109799601-109799740
  hyper
acgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 9733 - DNA, 117 bp, Homo sapiens; identical to SEQ ID NO: 3359
  chr8:110703765-110703882
  hyper

SEQ ID NO: 9734 - DNA, 30 bp, Homo sapiens
  chr8:110704224-110704254
  hyper
gaacactgacttcagcgtgaacctaaggtg

SEQ ID NO: 9735 - DNA, 52 bp, Homo sapiens
  chr8:110986212-110986264
  hyper
ctgcaggaaggagagcgcgcacagctgctccatgacatgcaggcggccggtg

SEQ ID NO: 9736 - DNA, 354 bp, Homo sapiens
  chr8:110986328-110986682
  hyper
cggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcc

SEQ ID NO: 9737 - DNA, 85 bp, Homo sapiens
  chr8:110986934-110987019
  hyper
ctggcccttcccaaacgttgtcaccccgcctcccaacttcgcaattgcgattcccagcccaggaggtgtacagattgaatgactc

SEQ ID NO: 9738 - DNA, 202 bp, Homo sapiens
  chr8:110987020-110987222
  hyper
ctacttggtgggtggaggggttggggaagggaggaaggagggagatgtggggcggaggaggaggaagaggagagaagatgactcttagctgaacgcaagcaagcaagcaagcaagggggatggcgagactcactcctgcccgcaggagaccaaaacaaaaagttcagaaagcaaaggaagtggtaaccgggtcccttccaac

SEQ ID NO: 9739 - DNA, 146 bp, Homo sapiens
  chr8:110987765-110987911
  hyper
ggcccctggaagctgcgctccagccaacctgttggactcggggtgaggaggtgggggtgggagggaagagcaagtgactcacctgcagctcccggcacatctggtctgcgcacaaccggcgccgcaggtaacgtactcttcttttg

SEQ ID NO: 9740 - DNA, 408 bp, Homo sapiens; identical to SEQ ID NO: 837
  chr8:114444784-114445192
  hyper

SEQ ID NO: 9741 - DNA, 41 bp, Homo sapiens
  chr8:114445521-114445562
  hyper
gttgggaaagactgtcgccttatgggcgaggactgtgggtg

SEQ ID NO: 9742 - DNA, 30 bp, Homo sapiens
  chr8:114445847-114445877
  hyper
gcgcgacgccgcacccggtctcccacctgc

SEQ ID NO: 9743 - DNA, 179 bp, Homo sapiens; identical to SEQ ID NO: 3361
  chr8:114446958-114447137
  hyper

SEQ ID NO: 9744 - DNA, 30 bp, Homo sapiens
  chr8:114447368-114447398
  hyper
gtaagcaacctgagccgtgctttgtacatt

SEQ ID NO: 9745 - DNA, 30 bp, Homo sapiens
  chr8:114448796-114448826
  hyper
atcagattattttatcggtgcaaattgcaa

SEQ ID NO: 9746 - DNA, 32 bp, Homo sapiens
  chr8:114449074-114449106
  hyper
ccctttcatattattcgcgagctcctaattcc

SEQ ID NO: 9747 - DNA, 23 bp, Homo sapiens
  chr8:116660615-116660638
  hyper
cgataacacgcccacagcccggg

SEQ ID NO: 9748 - DNA, 139 bp, Homo sapiens; identical to SEQ ID NO: 3363
  chr8:117950379-117950518
  hyper

SEQ ID NO: 9749 - DNA, 173 bp, Homo sapiens; identical to SEQ ID NO: 3364
  chr8:117950779-117950952
  hyper

SEQ ID NO: 9750 - DNA, 30 bp, Homo sapiens
  chr8:121136879-121136909
  hyper
ggagaagaggaggctcgaagggggccttta

SEQ ID NO: 9751 - DNA, 297 bp, Homo sapiens; identical to SEQ ID NO: 3365
  chr8:121137130-121137427
  hyper

SEQ ID NO: 9752 - DNA, 45 bp, Homo sapiens; identical to SEQ ID NO: 3366
  chr8:121137638-121137683
  hyper

SEQ ID NO: 9753 - DNA, 30 bp, Homo sapiens
  chr8:122652164-122652194
  hyper
ccccagatctcccaccgggcagtgtcccca

SEQ ID NO: 9754 - DNA, 323 bp, Homo sapiens
  chr8:124173095-124173418
  hyper
gaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtcagggtcgcctccccacggggtcgcagatgagggagtggggccgcgcagggaggctcctgcaggccgtgacccccaggcctggcccgtagagagtgactgatggcgaggacccgctggggacccgagggcctcagcctgcgcctgcgccggggctccccgaccaagaccttcc

SEQ ID NO: 9755 - DNA, 33 bp, Homo sapiens
  chr8:131455313-131455346
  hyper
gggagggcgccccatcggcggggtccgggccgc

SEQ ID NO: 9756 - DNA, 102 bp, Homo sapiens
  chr8:131455680-131455782
  hyper
cgcgcccgagcgccccgcaactcaccgggacctggcgggccgctgggcattattccatcgcgggttcggccgggcgctcgcggctctcgggtgggaaagcga

SEQ ID NO: 9757 - DNA, 295 bp, Homo sapiens; identical to SEQ ID NO: 3367
  chr8:132052005-132052300
  hyper

SEQ ID NO: 9758 - DNA, 118 bp, Homo sapiens; identical to SEQ ID NO: 3368
  chr8:132052398-132052516
  hyper

SEQ ID NO: 9759 - DNA, 367 bp, Homo sapiens; identical to SEQ ID NO: 3369
  chr8:132052589-132052956
  hyper

SEQ ID NO: 9760 - DNA, 30 bp, Homo sapiens
  chr8:132053488-132053518
  hyper
tcatcccctttatttcgttctttggagtcc

SEQ ID NO: 9761 - DNA, 777 bp, Homo sapiens; identical to SEQ ID NO: 838
  chr8:132053807-132054584
  hyper

SEQ ID NO: 9762 - DNA, 164 bp, Homo sapiens; identical to SEQ ID NO: 839
  chr8:132054593-132054757
  hyper

SEQ ID NO: 9763 - DNA, 257 bp, Homo sapiens
  chr8:133492359-133492616
  hyper
ccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgcca

SEQ ID NO: 9764 - DNA, 41 bp, Homo sapiens
  chr8:133493711-133493752
  hyper
taaaagccaagttgtcgggttggtcaaggccgggcgcaccg

SEQ ID NO: 9765 - DNA, 190 bp, Homo sapiens
  chr8:139508757-139508947
  hyper
gagactggggaaaatcgagggagataaaccacattttgcggcggaatcgctgttccgtgacagaaagccatccaactggcaaccacgcttgcagaagcgtcactaccaccgacgagagagttttgcagctgccgaccccgaagcgctctcacctacctgtctccactgcagggctcccctctctctcccc

SEQ ID NO: 9766 - DNA, 30 bp, Homo sapiens
  chr8:139926700-139926730
  hyper
ctttgggaagtttggcgccaccagggggcc

SEQ ID NO: 9767 - DNA, 293 bp, Homo sapiens; identical to SEQ ID NO: 840
  chr8:140714570-140714863
  hyper

SEQ ID NO: 9768 - DNA, 369 bp, Homo sapiens
  chr8:140715219-140715588
  hyper
cgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggc

SEQ ID NO: 9769 - DNA, 75 bp, Homo sapiens
  chr8:140715859-140715934
  hyper
gggaggaaaagtttgcgaagtggcggtgtctctggagtcccctgcaagcggggagggggccgagcaggtgcagcg

SEQ ID NO: 9770 - DNA, 197 bp, Homo sapiens
  chr8:140716694-140716891
  hyper
cccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccac

SEQ ID NO: 9771 - DNA, 30 bp, Homo sapiens
  chr8:140717104-140717134
  hyper
gacatcgcaatcccccgacccagtaacctc

SEQ ID NO: 9772 - DNA, 145 bp, Homo sapiens
  chr8:142528462-142528607
  hyper
tcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgca

SEQ ID NO: 9773 - DNA, 112 bp, Homo sapiens
  chr8:142528670-142528782
  hyper
cgcgcggggcccgggcccggcctcgtcctgctgctgcccggccccgccgccgccttcccggagcccgaggccagcgcttccagcgacggcacccccaggctggcccaggccc

SEQ ID NO: 9774 - DNA, 128 bp, Homo sapiens
  chr8:142528834-142528962
  hyper
cgcgcccggcgcttttctgcacacactccgacaggcctgggcggctgggcccggcggggaaggggggcggtgggacggtgggacggtggaccaggaacccaactgggacaccgggccaggccgggcag

SEQ ID NO: 9775 - DNA, 15 bp, Homo sapiens
  chr8:142529027-142529042
  hyper
cggaggcaggccctc

SEQ ID NO: 9776 - DNA, 177 bp, Homo sapiens
  chr8:143530536-143530713
  hyper
gtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatct

SEQ ID NO: 9777 - DNA, 352 bp, Homo sapiens
  chr8:143531062-143531414
  hyper
agcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggattt

SEQ ID NO: 9778 - DNA, 125 bp, Homo sapiens
  chr8:143531646-143531771
  hyper
ccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 9779 - DNA, 191 bp, Homo sapiens
  chr8:143532041-143532232
  hyper
ccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcg

SEQ ID NO: 9780 - DNA, 5 bp, Homo sapiens
  chr8:143532505-143532510
  hyper
ggcct

SEQ ID NO: 9781 - DNA, 958 bp, Homo sapiens; identical to SEQ ID NO: 3374
  chr8:143532541-143533499
  hyper

SEQ ID NO: 9782 - DNA, 141 bp, Homo sapiens; identical to SEQ ID NO: 3375
  chr8:143533500-143533641
  hyper

SEQ ID NO: 9783 - DNA, 343 bp, Homo sapiens; identical to SEQ ID NO: 3376
  chr8:143533708-143534051
  hyper

SEQ ID NO: 9784 - DNA, 195 bp, Homo sapiens
  chr8:143591612-143591807
  hyper
gcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 9785 - DNA, 17 bp, Homo sapiens
  chr8:143591888-143591905
  hyper
cgcgcccctccgggcct

SEQ ID NO: 9786 - DNA, 146 bp, Homo sapiens
  chr8:143592126-143592272
  hyper
cctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcc

SEQ ID NO: 9787 - DNA, 24 bp, Homo sapiens
  chr8:143592663-143592687
  hyper
cgggacccccggaaagtggctgat

SEQ ID NO: 9788 - DNA, 45 bp, Homo sapiens
  chr8:143859143-143859188
  hyper
gcagtgattccctggcgaccctcagactcacgtgttcagcccgga

SEQ ID NO: 9789 - DNA, 153 bp, Homo sapiens; identical to SEQ ID NO: 3377
  chr8:144241281-144241434
  hyper

SEQ ID NO: 9790 - DNA, 87 bp, Homo sapiens; identical to SEQ ID NO: 3378
  chr8:144241435-144241522
  hyper

SEQ ID NO: 9791 - DNA, 292 bp, Homo sapiens; identical to SEQ ID NO: 3379
  chr8:144241871-144242163
  hyper

SEQ ID NO: 9792 - DNA, 317 bp, Homo sapiens; identical to SEQ ID NO: 3380
  chr8:144328254-144328571
  hyper

SEQ ID NO: 9793 - DNA, 87 bp, Homo sapiens
  chr8:144503405-144503492
  hyper
cccatacctgagcctcgtgccgcccgggattgcggcgcccgcgccaccacgctggggtaatggtcccagcaccgctgccctgcgtcc

SEQ ID NO: 9794 - DNA, 30 bp, Homo sapiens
  chr8:144509088-144509118
  hyper
ggtcctgtactttctcggccagggaaaggc

SEQ ID NO: 9795 - DNA, 30 bp, Homo sapiens
  chr8:144509520-144509550
  hyper
tcctccaggtctctccgcttgaaacgataa

SEQ ID NO: 9796 - DNA, 568 bp, Homo sapiens
  chr8:144509993-144510561
  hyper
tccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaa

SEQ ID NO: 9797 - DNA, 65 bp, Homo sapiens
  chr8:144510915-144510980
  hyper
ggggcaggcaggggccgggcccctcctggcgagcgactcatgctgtgactcgcgactgagggcgg

SEQ ID NO: 9798 - DNA, 933 bp, Homo sapiens; identical to SEQ ID NO: 3381
  chr8:144511184-144512117
  hyper

SEQ ID NO: 9799 - DNA, 118 bp, Homo sapiens
  chr8:144651780-144651898
  hyper
gcacctgctgggactcggggtcagcctcttgcagacctcgccgcgaccgggccaagcccctctccacccctccccttctctcacaccttcctgcgattcagcgcgaggtggcccaggc

SEQ ID NO: 9800 - DNA, 65 bp, Homo sapiens
  chr8:145700341-145700406
  hyper
gcggtgttctgcagccggagcgcctcagctgggatcaggctcacgtcgaccgcccagaagttgcc

SEQ ID NO: 9801 - DNA, 30 bp, Homo sapiens
  chr8:145806218-145806248
  hyper
cccgccctcacctgccgctgtcctccttca

SEQ ID NO: 9802 - DNA, 40 bp, Homo sapiens
  chr9:73266-73306
  hyper
ccggatgaagttgggcgggtagctgcgctggccctggaag

SEQ ID NO: 9803 - DNA, 93 bp, Homo sapiens
  chr9:113420-113513
  hyper
cgcagcccagcttcccgggcaggctccacgctaccggggtccagtgcgcggcgacgaagcggagagctgtgtccagactccggagagaaactc

SEQ ID NO: 9804 - DNA, 7 bp, Homo sapiens
  chr9:113549-113556
  hyper
ggagctg

SEQ ID NO: 9805 - DNA, 380 bp, Homo sapiens
  chr9:113774-114154
  hyper
ccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 9806 - DNA, 102 bp, Homo sapiens
  chr9:114750-114852
  hyper
cggacccctccaagccgcctgggagcttccaaacaggtggacccgaagctcctgtttgatcggagaataacgttcaatttactccgccgctgaactgatggt

SEQ ID NO: 9807 - DNA, 84 bp, Homo sapiens; identical to SEQ ID NO: 841
  chr9:117876-117960
  hyper

SEQ ID NO: 9808 - DNA, 144 bp, Homo sapiens; identical to SEQ ID NO: 3383
  chr9:841706-841850
  hyper

SEQ ID NO: 9809 - DNA, 181 bp, Homo sapiens; identical to SEQ ID NO: 3384
  chr9:841851-842032
  hyper

SEQ ID NO: 9810 - DNA, 1 bp, Homo sapiens
  chr9:842207-842208
  hyper
c

SEQ ID NO: 9811 - DNA, 43 bp, Homo sapiens
  chr9:842922-842965
  hyper
agtcttcaggatcttcgctcccgccctccgaggtgaggctaga

SEQ ID NO: 9812 - DNA, 141 bp, Homo sapiens
  chr9:843219-843360
  hyper
gccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctg

SEQ ID NO: 9813 - DNA, 187 bp, Homo sapiens
  chr9:969799-969986
  hyper
gacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttg

SEQ ID NO: 9814 - DNA, 30 bp, Homo sapiens; identical to SEQ ID NO: 842
  chr9:970195-970225
  hyper

SEQ ID NO: 9815 - DNA, 59 bp, Homo sapiens
  chr9:970533-970592
  hyper
taagagtgcgcagaacgcgtgtgttcaagtgtgggcgtggcaggcgtcgtgtgctcgcc

SEQ ID NO: 9816 - DNA, 42 bp, Homo sapiens
  chr9:971138-971180
  hyper
gcagctcccggccaccgggcgccggtggctcacgcctgtaat

SEQ ID NO: 9817 - DNA, 56 bp, Homo sapiens
  chr9:972016-972072
  hyper
gctgggaggggaaagcggggcgtgtctggggggcggggccccgagcactccggaag

SEQ ID NO: 9818 - DNA, 414 bp, Homo sapiens; identical to SEQ ID NO: 843
  chr9:972345-972759
  hyper

SEQ ID NO: 9819 - DNA, 67 bp, Homo sapiens
  chr9:973183-973250
  hyper
cggtatccccgggccggtgaccccggggttcagtcgtctccccgaccccaagcggcctctgctttcc

SEQ ID NO: 9820 - DNA, 136 bp, Homo sapiens
  chr9:975809-975945
  hyper
agtagctgctgggagcgagggaagaggatatcggtaactttgggggcgccaatgtggcttctgtgtctgccccttgaaagtttatacccggcgcttaacaaatcctttacaggagcacgtacgtccctgacctttc

SEQ ID NO: 9821 - DNA, 52 bp, Homo sapiens
  chr9:976147-976199
  hyper
aactccacccaggtccggggtgcaaccgcaacactcccgtaggttcgagttc

SEQ ID NO: 9822 - DNA, 255 bp, Homo sapiens
  chr9:976435-976690
  hyper
cttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 9823 - DNA, 96 bp, Homo sapiens
  chr9:977422-977518
  hyper
ccggggctctgcaggcgcagctcgccaagccaggtaagagcgtctgaggtgcgggagtttggccgggcgcgggggcaacttcggagtgccagctgc

SEQ ID NO: 9824 - DNA, 46 bp, Homo sapiens
  chr9:981797-981843
  hyper
ctgagcccagcttctcgccgcctgctggggacggctctttccttgg

SEQ ID NO: 9825 - DNA, 175 bp, Homo sapiens; identical to SEQ ID NO: 3388
  chr9:1042326-1042501
  hyper

SEQ ID NO: 9826 - DNA, 328 bp, Homo sapiens; identical to SEQ ID NO: 3389
  chr9:1042615-1042943
  hyper

SEQ ID NO: 9827 - DNA, 274 bp, Homo sapiens; identical to SEQ ID NO: 844
  chr9:1052044-1052318
  hyper

SEQ ID NO: 9828 - DNA, 307 bp, Homo sapiens
  chr9:3181573-3181880
  hyper
tcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagcacacaagtttggagagcgcgcgaggcacctgaaagtggttggggtttggaagcaaaagggtgacacctgctgttcgctgggaccgctctgcgggtgtgggcgtcggtttggaaacgtcctttgcctgag

SEQ ID NO: 9829 - DNA, 30 bp, Homo sapiens
  chr9:4299034-4299064
  hyper
ccgtgcgtcctgtaacgtgccctgattgtg

SEQ ID NO: 9830 - DNA, 58 bp, Homo sapiens
  chr9:4299348-4299406
  hyper
ccccacactctcaagcgcccggtttctcctcgtctctcgcctgcgagcaaagttccta

SEQ ID NO: 9831 - DNA, 30 bp, Homo sapiens
  chr9:4299642-4299672
  hyper
ctgcgagggcagcggcggcagggggaggag

SEQ ID NO: 9832 - DNA, 94 bp, Homo sapiens
  chr9:4299969-4300063
  hyper
gggctgcccgggcggcgcagtgtggacgcggctgcagggagaggggaagggggaagagggagggaggaaggcagccgggcgaggagtgtggatg

SEQ ID NO: 9833 - DNA, 263 bp, Homo sapiens; identical to SEQ ID NO: 3391
  chr9:6412587-6412850
  hyper

SEQ ID NO: 9834 - DNA, 17 bp, Homo sapiens
  chr9:6644351-6644368
  hyper
aacgcaggggaagctcg

SEQ ID NO: 9835 - DNA, 268 bp, Homo sapiens; identical to SEQ ID NO: 845
  chr9:6645065-6645333
  hyper

SEQ ID NO: 9836 - DNA, 433 bp, Homo sapiens
  chr9:6645594-6646027
  hyper
gcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctg

SEQ ID NO: 9837 - DNA, 30 bp, Homo sapiens
  chr9:8857443-8857473
  hyper
gagaggacctctgcccgaggaggtccagag

SEQ ID NO: 9838 - DNA, 47 bp, Homo sapiens
  chr9:8858369-8858416
  hyper
gcctgggaaagggcccgagcagagtcgagggccgggaggtggggtgg

SEQ ID NO: 9839 - DNA, 183 bp, Homo sapiens
  chr9:13278748-13278931
  hyper
accggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctg

SEQ ID NO: 9840 - DNA, 32 bp, Homo sapiens
  chr9:13279717-13279749
  hyper
cggcggggcggcgggcgcgccttggccaatca

SEQ ID NO: 9841 - DNA, 345 bp, Homo sapiens; identical to SEQ ID NO: 3394
  chr9:14348107-14348452
  hyper

SEQ ID NO: 9842 - DNA, 43 bp, Homo sapiens
  chr9:16870864-16870907
  hyper
cactcgcgccggggtcgcgctcgcgccccgagtcccagccggc

SEQ ID NO: 9843 - DNA, 42 bp, Homo sapiens
  chr9:17135632-17135674
  hyper
cggccagacaggcttcgcctccgcgcccgggtttggttttgg

SEQ ID NO: 9844 - DNA, 48 bp, Homo sapiens
  chr9:17578826-17578874
  hyper
gctgccaatctgcagcgacccgtccgcagcccccgggggcaggaacac

SEQ ID NO: 9845 - DNA, 63 bp, Homo sapiens
  chr9:17579090-17579153
  hyper
tgtcccgctaggctccgcgccctcgcgcccatagccccggcggcggcacgaccagaggcggcc

SEQ ID NO: 9846 - DNA, 223 bp, Homo sapiens
  chr9:17579476-17579699
  hyper
gcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggat

SEQ ID NO: 9847 - DNA, 51 bp, Homo sapiens
  chr9:17906058-17906109
  hyper
gaaaagctccatgagcgcccaggggacaagtccccacggacaaacatgtca

SEQ ID NO: 9848 - DNA, 29 bp, Homo sapiens
  chr9:17906404-17906433
  hyper
ataaatagaagccagcgcgcagccccgct

SEQ ID NO: 9849 - DNA, 210 bp, Homo sapiens
  chr9:17906460-17906670
  hyper
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctcca

SEQ ID NO: 9850 - DNA, 22 bp, Homo sapiens
  chr9:17907450-17907472
  hyper
cggacgccggaccaggtgggct

SEQ ID NO: 9851 - DNA, 30 bp, Homo sapiens
  chr9:19127231-19127261
  hyper
ccaggacctggaagccgcgaggcgagcggg

SEQ ID NO: 9852 - DNA, 30 bp, Homo sapiens
  chr9:19788506-19788536
  hyper
aatctaaaggacagacgccccacctgtgag

SEQ ID NO: 9853 - DNA, 153 bp, Homo sapiens; identical to SEQ ID NO: 846
  chr9:19789107-19789260
  hyper

SEQ ID NO: 9854 - DNA, 294 bp, Homo sapiens
  chr9:21031479-21031773
  hyper
gcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttggggaagagatgaaaacgaagttctcgaagtttctgcagc

SEQ ID NO: 9855 - DNA, 46 bp, Homo sapiens
  chr9:21396004-21396050
  hyper
acactgactacggcacgatctgattttgagccgtcagtcccctcaa

SEQ ID NO: 9856 - DNA, 38 bp, Homo sapiens
  chr9:21396276-21396314
  hyper
tggtgggtccgttaccgctggtccggcgccctctgtcg

SEQ ID NO: 9857 - DNA, 556 bp, Homo sapiens; identical to SEQ ID NO: 3397
  chr9:21402590-21403146
  hyper

SEQ ID NO: 9858 - DNA, 83 bp, Homo sapiens
  chr9:21965057-21965140
  hyper
ttggtgctggaggcccggccaaaggaagggctgctctcccgtcccgcgggctccgaggtcgccgcacccgggcgcgcctgggc

SEQ ID NO: 9859 - DNA, 191 bp, Homo sapiens
  chr9:21965569-21965760
  hyper
cgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaa

SEQ ID NO: 9860 - DNA, 225 bp, Homo sapiens
  chr9:21968456-21968681
  hyper
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggc

SEQ ID NO: 9861 - DNA, 19 bp, Homo sapiens
  chr9:21969231-21969250
  hyper
acaaacaaacccaggcgtc

SEQ ID NO: 9862 - DNA, 30 bp, Homo sapiens
  chr9:21970999-21971029
  hyper
cctcagccaggtccacgggcagacggcccc

SEQ ID NO: 9863 - DNA, 913 bp, Homo sapiens; identical to SEQ ID NO: 3398
  chr9:21974204-21975117
  hyper

SEQ ID NO: 9864 - DNA, 418 bp, Homo sapiens; identical to SEQ ID NO: 3399
  chr9:21975190-21975608
  hyper

SEQ ID NO: 9865 - DNA, 56 bp, Homo sapiens
  chr9:22447029-22447085
  hyper
tccacttgggactcccggccagaaatttctcgggaatggagcggtcacagtgtggc

SEQ ID NO: 9866 - DNA, 30 bp, Homo sapiens
  chr9:23822576-23822606
  hyper
tcagacccggccccacggctggaagtcaaa

SEQ ID NO: 9867 - DNA, 462 bp, Homo sapiens
  chr9:23824129-23824591
  hyper
aaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataattta

SEQ ID NO: 9868 - DNA, 39 bp, Homo sapiens
  chr9:23826326-23826365
  hyper
gccaggctcctatcccgggcagcacgcgcggaagtatac

SEQ ID NO: 9869 - DNA, 30 bp, Homo sapiens
  chr9:23831139-23831169
  hyper
tatgcttccgatgctcggaggctctttctt

SEQ ID NO: 9870 - DNA, 15 bp, Homo sapiens
  chr9:23831450-23831465
  hyper
cgggccacggtgaca

SEQ ID NO: 9871 - DNA, 97 bp, Homo sapiens
  chr9:29212210-29212307
  hyper
cggaagcgcgccgggactgccgctcacgtcccccgcccctgccgcgcgggctccgccaccccgcgagcacgctggctctccgcgctcaccccgccgc

SEQ ID NO: 9872 - DNA, 51 bp, Homo sapiens
  chr9:29212731-29212782
  hyper
tctggcttcctgcctcgcagctgggcagcgccgcaccggctactccctgac

SEQ ID NO: 9873 - DNA, 30 bp, Homo sapiens
  chr9:29213181-29213211
  hyper
tattcagttttcttccgtaaccccacagac

SEQ ID NO: 9874 - DNA, 111 bp, Homo sapiens
  chr9:29213524-29213635
  hyper
ggctgcaaggcgggacgcaggatagccggctggggcttggcagccgggctcagagctcgggctgcgcacacacacaggcgcgcacacccgcgcgcgcgcagctacacacgc

SEQ ID NO: 9875 - DNA, 54 bp, Homo sapiens
  chr9:29214035-29214089
  hyper
gcctacacatcgcttcgtgaacataatcccctcgcatcccgtctttacctgccc

SEQ ID NO: 9876 - DNA, 70 bp, Homo sapiens
  chr9:29214360-29214430
  hyper
ttctttttcttccctcgacggtcgggagggatcactgggtgctacaccgctggggcgtcccaggcaggag

SEQ ID NO: 9877 - DNA, 32 bp, Homo sapiens
  chr9:29214681-29214713
  hyper
tgccctctggggcttcgcgaatatctatggct

SEQ ID NO: 9878 - DNA, 93 bp, Homo sapiens; identical to SEQ ID NO: 847
  chr9:29214993-29215086
  hyper

SEQ ID NO: 9879 - DNA, 256 bp, Homo sapiens; identical to SEQ ID NO: 3401
  chr9:32782680-32782936
  hyper

SEQ ID NO: 9880 - DNA, 138 bp, Homo sapiens; identical to SEQ ID NO: 3402
  chr9:32783083-32783221
  hyper

SEQ ID NO: 9881 - DNA, 161 bp, Homo sapiens; identical to SEQ ID NO: 3403
  chr9:32783259-32783420
  hyper

SEQ ID NO: 9882 - DNA, 48 bp, Homo sapiens; identical to SEQ ID NO: 3404
  chr9:32783590-32783638
  hyper

SEQ ID NO: 9883 - DNA, 95 bp, Homo sapiens
  chr9:33523986-33524081
  hyper
gaaccgaccctcagccccatccccgcggacggtccctggagcggccccgatctctcttcggagaagaggggcgggagtcacggccaggcgggaag

SEQ ID NO: 9884 - DNA, 194 bp, Homo sapiens
  chr9:33524499-33524693
  hyper
ctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacag

SEQ ID NO: 9885 - DNA, 614 bp, Homo sapiens
  chr9:33676771-33677385
  hyper
tgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggc

SEQ ID NO: 9886 - DNA, 195 bp, Homo sapiens
  chr9:34589062-34589257
  hyper
acacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgagggg

SEQ ID NO: 9887 - DNA, 30 bp, Homo sapiens
  chr9:34590193-34590223
  hyper
cccgctcccctagggcggctgggcgcgcac

SEQ ID NO: 9888 - DNA, 154 bp, Homo sapiens
  chr9:35675494-35675648
  hyper
ggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcc

SEQ ID NO: 9889 - DNA, 294 bp, Homo sapiens
  chr9:35675837-35676131
  hyper
gccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctg

SEQ ID NO: 9890 - DNA, 65 bp, Homo sapiens
  chr9:35728859-35728924
  hyper
agggctcccagtccacgagatgagtgaataagccaagtacagaatcacaacggagggcaggatgt

SEQ ID NO: 9891 - DNA, 308 bp, Homo sapiens
  chr9:36037287-36037595
  hyper
ccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 9892 - DNA, 261 bp, Homo sapiens
  chr9:36258385-36258646
  hyper
acgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 9893 - DNA, 321 bp, Homo sapiens
  chr9:36258697-36259018
  hyper
cgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggaca

SEQ ID NO: 9894 - DNA, 148 bp, Homo sapiens; identical to SEQ ID NO: 3405
  chr9:36739852-36740000
  hyper

SEQ ID NO: 9895 - DNA, 6 bp, Homo sapiens
  chr9:37002512-37002518
  hyper
gcgggc

SEQ ID NO: 9896 - DNA, 171 bp, Homo sapiens; identical to SEQ ID NO: 3407
  chr9:37002818-37002989
  hyper

SEQ ID NO: 9897 - DNA, 1046 bp, Homo sapiens; identical to SEQ ID NO: 3408
  chr9:37025306-37026352
  hyper

SEQ ID NO: 9898 - DNA, 839 bp, Homo sapiens; identical to SEQ ID NO: 3409
  chr9:37026433-37027272
  hyper

SEQ ID NO: 9899 - DNA, 60 bp, Homo sapiens; identical to SEQ ID NO: 3410
  chr9:37027324-37027384
  hyper

SEQ ID NO: 9900 - DNA, 444 bp, Homo sapiens; identical to SEQ ID NO: 3411
  chr9:37027385-37027829
  hyper

SEQ ID NO: 9901 - DNA, 30 bp, Homo sapiens
  chr9:37028470-37028500
  hyper
agttagtaactggggcgcaccagggcgcac

SEQ ID NO: 9902 - DNA, 43 bp, Homo sapiens
  chr9:37029348-37029391
  hyper
cagtagacaagtttccggcgctgacacccgtccccacccccca

SEQ ID NO: 9903 - DNA, 874 bp, Homo sapiens; identical to SEQ ID NO: 848
  chr9:37029893-37030767
  hyper

SEQ ID NO: 9904 - DNA, 647 bp, Homo sapiens
  chr9:37034217-37034864
  hyper
taggtggaaaaaaagcgtccgaaggcaccgtgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcaccttctattaagacatgcgcttgggggtcgcggccctctgcgctgtgcgcggggcctgtgacatctccatgtgcaaaccccgctgcttagacgagcgcaggccgggtttttgtttttgaagaaattaactgctcggccaagcaggtgcttttgaaaggggttgcaaaggctggcagtgttgccaggcaccgaggcgacgttccggtttactccgattcacccctagggcggcgcccgaccccagggttcc

SEQ ID NO: 9905 - DNA, 246 bp, Homo sapiens
  chr9:37035534-37035780
  hyper
gaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagcccca

SEQ ID NO: 9906 - DNA, 432 bp, Homo sapiens; identical to SEQ ID NO: 3413
  chr9:37036462-37036894
  hyper

SEQ ID NO: 9907 - DNA, 812 bp, Homo sapiens; identical to SEQ ID NO: 849
  chr9:37037453-37038265
  hyper

SEQ ID NO: 9908 - DNA, 54 bp, Homo sapiens
  chr9:38424355-38424409
  hyper
cagcggcggcagcagcggcagcagcagcagaagcagcagcggcaagagcagaga

SEQ ID NO: 9909 - DNA, 30 bp, Homo sapiens
  chr9:38621877-38621907
  hyper
acatctgcccacagccgcagcctcctgcac

SEQ ID NO: 9910 - DNA, 42 bp, Homo sapiens
  chr9:38622559-38622601
  hyper
gcccgagagacagcacgtcaccgtcaccgtcaccgcctagcg

SEQ ID NO: 9911 - DNA, 25 bp, Homo sapiens
  chr9:66458550-66458575
  hyper
gggcggcctcctttccgcccacgct

SEQ ID NO: 9912 - DNA, 34 bp, Homo sapiens
  chr9:66494123-66494157
  hyper
ctgctggaatgcttgcgctcgaggcctgagggac

SEQ ID NO: 9913 - DNA, 166 bp, Homo sapiens
  chr9:71788978-71789144
  hyper
tcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaa

SEQ ID NO: 9914 - DNA, 78 bp, Homo sapiens
  chr9:74061681-74061759
  hyper
tctccgcgttgtcctcgcggtcggagcagccccgctccatttccgccgcatccctccacttcttccccatgagaagtt

SEQ ID NO: 9915 - DNA, 304 bp, Homo sapiens
  chr9:74061787-74062091
  hyper
cgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctc

SEQ ID NO: 9916 - DNA, 49 bp, Homo sapiens
  chr9:74764314-74764363
  hyper
cggcctgcagggtaccggcaaccgcccgggtaagcgggggcaggacaag

SEQ ID NO: 9917 - DNA, 80 bp, Homo sapiens
  chr9:77111763-77111843
  hyper
caaaccacctgcccacggaaacccccgccggagaccgaagtttacccaaatagcgctcggcaaagcgctgccataaattc

SEQ ID NO: 9918 - DNA, 69 bp, Homo sapiens
  chr9:77112827-77112896
  hyper
gggctctccggggttcgggctgggagcagcttcatgactacgcggagcgggagagcggccacaccatgc

SEQ ID NO: 9919 - DNA, 436 bp, Homo sapiens
  chr9:77112897-77113333
  hyper
aggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcaggg

SEQ ID NO: 9920 - DNA, 45 bp, Homo sapiens
  chr9:77113664-77113709
  hyper
tgtcagataaagggccggtagtggaaggaggtgctggtgcaccct

SEQ ID NO: 9921 - DNA, 20 bp, Homo sapiens
  chr9:77113805-77113825
  hyper
cgttacgcttgctccggctg

SEQ ID NO: 9922 - DNA, 124 bp, Homo sapiens
  chr9:77114745-77114869
  hyper
ttcatactttctgaacgtcgtaaactatgcgccacctcagctcggacccagcactaggacctagggcataaaatccgctcactccttacatcgtagaaggagtgcggcgcggggtggggatggg

SEQ ID NO: 9923 - DNA, 30 bp, Homo sapiens; identical to SEQ ID NO: 3415
  chr9:77115417-77115447
  hyper

SEQ ID NO: 9924 - DNA, 522 bp, Homo sapiens; identical to SEQ ID NO: 850
  chr9:79626876-79627398
  hyper

SEQ ID NO: 9925 - DNA, 35 bp, Homo sapiens
  chr9:79628238-79628273
  hyper
tggatcaacaacatccgccccgcccccccaactcc

SEQ ID NO: 9926 - DNA, 199 bp, Homo sapiens; identical to SEQ ID NO: 851
  chr9:79629207-79629406
  hyper

SEQ ID NO: 9927 - DNA, 54 bp, Homo sapiens
  chr9:79631016-79631070
  hyper
gtcggaattaacctccggggaagtaggggaagaggagagcgcgcccccctcccc

SEQ ID NO: 9928 - DNA, 36 bp, Homo sapiens
  chr9:79631555-79631591
  hyper
gccgcaagtgcccaacgggcacggtcccagagctgc

SEQ ID NO: 9929 - DNA, 43 bp, Homo sapiens
  chr9:79631911-79631954
  hyper
tctcaagtgtctcagcggacaaaaatcgcgcagaaactcctat

SEQ ID NO: 9930 - DNA, 30 bp, Homo sapiens
  chr9:79632823-79632853
  hyper
ccccagctcagacatcgccatcccagagaa

SEQ ID NO: 9931 - DNA, 350 bp, Homo sapiens; identical to SEQ ID NO: 3418
  chr9:79633334-79633684
  hyper

SEQ ID NO: 9932 - DNA, 531 bp, Homo sapiens; identical to SEQ ID NO: 3419
  chr9:79634237-79634768
  hyper

SEQ ID NO: 9933 - DNA, 400 bp, Homo sapiens; identical to SEQ ID NO: 3420
  chr9:79635049-79635449
  hyper

SEQ ID NO: 9934 - DNA, 131 bp, Homo sapiens; identical to SEQ ID NO: 852
  chr9:79635834-79635965
  hyper

SEQ ID NO: 9935 - DNA, 295 bp, Homo sapiens; identical to SEQ ID NO: 853
  chr9:79636258-79636553
  hyper

SEQ ID NO: 9936 - DNA, 106 bp, Homo sapiens
  chr9:79636847-79636953
  hyper
aatgcaggaaaaactcggcacatcactcgacaatattgctcttaacgcttgcagaaacgttccatggctgttcccttccagtctcctcggacggaagcaaggggac

SEQ ID NO: 9937 - DNA, 135 bp, Homo sapiens
  chr9:79637184-79637319
  hyper
gctctaagtcacctccgcctcttgtccgcgccgcgttcgggttgtgactttgtttatgtctgctggtgttgtacgcggtgttctctattaaagcttctctctggatatctatgctagccccgtgtgaaggtgttt

SEQ ID NO: 9938 - DNA, 230 bp, Homo sapiens; identical to SEQ ID NO: 854
  chr9:79637659-79637889
  hyper

SEQ ID NO: 9939 - DNA, 46 bp, Homo sapiens; identical to SEQ ID NO: 855
  chr9:79638136-79638182
  hyper

SEQ ID NO: 9940 - DNA, 40 bp, Homo sapiens
  chr9:80263460-80263500
  hyper
gtttgctgtaatctgcgcgtctggccgccaggcaccgggt

SEQ ID NO: 9941 - DNA, 30 bp, Homo sapiens
  chr9:86152387-86152417
  hyper
atccctcaaggctggcgcccagggcagccc

SEQ ID NO: 9942 - DNA, 107 bp, Homo sapiens; identical to SEQ ID NO: 3425
  chr9:86755532-86755639
  hyper

SEQ ID NO: 9943 - DNA, 268 bp, Homo sapiens
  chr9:87283035-87283303
  hyper
cgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgt

SEQ ID NO: 9944 - DNA, 30 bp, Homo sapiens
  chr9:87283616-87283646
  hyper
tagctggatgcatatcgtgctccgggcagc

SEQ ID NO: 9945 - DNA, 30 bp, Homo sapiens
  chr9:87284009-87284039
  hyper
cccctccaaaaccaccgatccccaaatagg

SEQ ID NO: 9946 - DNA, 439 bp, Homo sapiens
  chr9:87284555-87284994
  hyper
ttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcat

SEQ ID NO: 9947 - DNA, 254 bp, Homo sapiens
  chr9:87285279-87285533
  hyper
gtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggact

SEQ ID NO: 9948 - DNA, 30 bp, Homo sapiens; identical to SEQ ID NO: 3426
  chr9:88137696-88137726
  hyper

SEQ ID NO: 9949 - DNA, 240 bp, Homo sapiens; identical to SEQ ID NO: 3427
  chr9:88137874-88138114
  hyper

SEQ ID NO: 9950 - DNA, 50 bp, Homo sapiens
  chr9:89560715-89560765
  hyper
ggggcgccaagcggccgccgccgccgctgctcctgcgcccaggcccatag

SEQ ID NO: 9951 - DNA, 35 bp, Homo sapiens
  chr9:89560977-89561012
  hyper
catgttctccttgaccgactcgcagatgggccgct

SEQ ID NO: 9952 - DNA, 2 bp, Homo sapiens
  chr9:90113746-90113748
  hyper
tg

SEQ ID NO: 9953 - DNA, 165 bp, Homo sapiens
  chr9:91150170-91150335
  hyper
tgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggc

SEQ ID NO: 9954 - DNA, 97 bp, Homo sapiens; identical to SEQ ID NO: 3428
  chr9:91606004-91606101
  hyper

SEQ ID NO: 9955 - DNA, 38 bp, Homo sapiens
  chr9:91606320-91606358
  hyper
gcggagcgcgggtcccgccccggcgggccgctggaaaa

SEQ ID NO: 9956 - DNA, 30 bp, Homo sapiens
  chr9:91792357-91792387
  hyper
tgagaaagtaaagcccgtcgaagagaaagc

SEQ ID NO: 9957 - DNA, 50 bp, Homo sapiens
  chr9:91793476-91793526
  hyper
ggagagtgggggccccgggacagccttctggagaacgagagcagagcaag

SEQ ID NO: 9958 - DNA, 30 bp, Homo sapiens
  chr9:91849779-91849809
  hyper
agaaacccctgaaatcggaaatactctaac

SEQ ID NO: 9959 - DNA, 67 bp, Homo sapiens
  chr9:94183858-94183925
  hyper
cagaccccaccggcccgcaggagggagcggcgcactgggggccgcacggactcgccattggagatcg

SEQ ID NO: 9960 - DNA, 30 bp, Homo sapiens
  chr9:94711494-94711524
  hyper
tcggccaccccagagcggtgggggagagga

SEQ ID NO: 9961 - DNA, 120 bp, Homo sapiens; identical to SEQ ID NO: 3429
  chr9:94712294-94712414
  hyper

SEQ ID NO: 9962 - DNA, 70 bp, Homo sapiens
  chr9:94713007-94713077
  hyper
aaaactgccaggggtcgagctgcgtggagggagccctcgggagcgcgatgctatccgaagccaccgcggc

SEQ ID NO: 9963 - DNA, 517 bp, Homo sapiens
  chr9:95569984-95570501
  hyper
tgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccag

SEQ ID NO: 9964 - DNA, 387 bp, Homo sapiens
  chr9:95571544-95571931
  hyper
ctcgggagcggtttccggagtccgagctggcgctgagctgcaggcgcgagcctaaaggcttagccggggcccacgctgtctgagagatcggagcgttcagctacaggcacgcgcttaacggcttcgtggagctcactcggtctgagaggtcggaggctgcgagtgtcgctgctgaaggctgtggtggaccaggctggatcgcggattctgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 9965 - DNA, 109 bp, Homo sapiens
  chr9:95572141-95572250
  hyper
agaaaagacaggtatcgggggctcagcctgcggtgggagggggccccaggcccggcttccctgcagcccctggggcgggggccttggagggccccgggcaccctcggag

SEQ ID NO: 9966 - DNA, 65 bp, Homo sapiens
  chr9:96588857-96588922
  hyper
cggggcgggttgccgcccctcccgggagtacgggcggaggcaggggcgggcgggggctttcagca

SEQ ID NO: 9967 - DNA, 129 bp, Homo sapiens
  chr9:96708329-96708458
  hyper
attgcctggtggaagcggagctgccgcgggggctggggcggcagcgcgtgcgggcggagttgcgttcggcagggcggacttggggcggctgtcaggggctctcccgggccaaggcgcaagagcaagacg

SEQ ID NO: 9968 - DNA, 651 bp, Homo sapiens; identical to SEQ ID NO: 3430
  chr9:96710796-96711447
  hyper

SEQ ID NO: 9969 - DNA, 83 bp, Homo sapiens; identical to SEQ ID NO: 3431
  chr9:96711534-96711617
  hyper

SEQ ID NO: 9970 - DNA, 266 bp, Homo sapiens
  chr9:96713627-96713893
  hyper
gaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctg

SEQ ID NO: 9971 - DNA, 524 bp, Homo sapiens; identical to SEQ ID NO: 3432
  chr9:96716904-96717428
  hyper

SEQ ID NO: 9972 - DNA, 85 bp, Homo sapiens; identical to SEQ ID NO: 3433
  chr9:96717449-96717534
  hyper

SEQ ID NO: 9973 - DNA, 220 bp, Homo sapiens; identical to SEQ ID NO: 3434
  chr9:96717979-96718199
  hyper

SEQ ID NO: 9974 - DNA, 8 bp, Homo sapiens
  chr9:96720878-96720886
  hyper
gaaaatcc

SEQ ID NO: 9975 - DNA, 366 bp, Homo sapiens; identical to SEQ ID NO: 857
  chr9:96721102-96721468
  hyper

SEQ ID NO: 9976 - DNA, 114 bp, Homo sapiens; identical to SEQ ID NO: 858
  chr9:96721688-96721802
  hyper

SEQ ID NO: 9977 - DNA, 212 bp, Homo sapiens; identical to SEQ ID NO: 859
  chr9:98111349-98111561
  hyper

SEQ ID NO: 9978 - DNA, 264 bp, Homo sapiens; identical to SEQ ID NO: 860
  chr9:98111894-98112158
  hyper

SEQ ID NO: 9979 - DNA, 52 bp, Homo sapiens; identical to SEQ ID NO: 861
  chr9:98112343-98112395
  hyper

SEQ ID NO: 9980 - DNA, 47 bp, Homo sapiens
  chr9:98783352-98783399
  hyper
cgggcacagggaggccgttcggctttccccctcgcgcccattactct

SEQ ID NO: 9981 - DNA, 33 bp, Homo sapiens
  chr9:98784201-98784234
  hyper
atggaatcagggccccggcgcccccacgccgct

SEQ ID NO: 9982 - DNA, 30 bp, Homo sapiens
  chr9:98784772-98784802
  hyper
gcacagaggggcactcggcttgtaagcaac

SEQ ID NO: 9983 - DNA, 306 bp, Homo sapiens; identical to SEQ ID NO: 3441
  chr9:98789707-98790013
  hyper

SEQ ID NO: 9984 - DNA, 40 bp, Homo sapiens
  chr9:99449297-99449337
  hyper
gcacagcgtcagaggcggggacgcgcgctggtctattttt

SEQ ID NO: 9985 - DNA, 432 bp, Homo sapiens; identical to SEQ ID NO: 862
  chr9:99639601-99640033
  hyper

SEQ ID NO: 9986 - DNA, 30 bp, Homo sapiens
  chr9:99983140-99983170
  hyper
aaattatccaccaagcgctacaggcgggaa

SEQ ID NO: 9987 - DNA, 27 bp, Homo sapiens
  chr9:99983988-99984015
  hyper
tcgcgcaggacatcccggaatcgcagg

SEQ ID NO: 9988 - DNA, 422 bp, Homo sapiens
  chr9:100503515-100503937
  hyper
cggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagc

SEQ ID NO: 9989 - DNA, 40 bp, Homo sapiens; identical to SEQ ID NO: 3444
  chr9:100610095-100610135
  hyper

SEQ ID NO: 9990 - DNA, 121 bp, Homo sapiens; identical to SEQ ID NO: 3445
  chr9:100610200-100610321
  hyper

SEQ ID NO: 9991 - DNA, 92 bp, Homo sapiens; identical to SEQ ID NO: 863
  chr9:100610725-100610817
  hyper

SEQ ID NO: 9992 - DNA, 516 bp, Homo sapiens; identical to SEQ ID NO: 864
  chr9:100611124-100611640
  hyper

SEQ ID NO: 9993 - DNA, 38 bp, Homo sapiens
  chr9:100613747-100613785
  hyper
agttactgagagccacgaaatcccgtattaaaaggtgc

SEQ ID NO: 9994 - DNA, 10 bp, Homo sapiens
  chr9:100613990-100614000
  hyper
ttccacacac

SEQ ID NO: 9995 - DNA, 133 bp, Homo sapiens; identical to SEQ ID NO: 3449
  chr9:100614192-100614325
  hyper

SEQ ID NO: 9996 - DNA, 243 bp, Homo sapiens
  chr9:100614584-100614827
  hyper
cactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttga

SEQ ID NO: 9997 - DNA, 133 bp, Homo sapiens; identical to SEQ ID NO: 3450
  chr9:100615068-100615201
  hyper

SEQ ID NO: 9998 - DNA, 834 bp, Homo sapiens; identical to SEQ ID NO: 3451
  chr9:100615202-100616036
  hyper

SEQ ID NO: 9999 - DNA, 199 bp, Homo sapiens; identical to SEQ ID NO: 3452
  chr9:100616270-100616469
  hyper

SEQ ID NO: 10000 - DNA, 49 bp, Homo sapiens
  chr9:100617316-100617365
  hyper
gagccagcgtagggacgaaaactcatagacacatcggctgttcacacgt

SEQ ID NO: 10001 - DNA, 37 bp, Homo sapiens
  chr9:100617675-100617712
  hyper
ccttccatgtgctgccggaactcgggcctttttacgc

SEQ ID NO: 10002 - DNA, 295 bp, Homo sapiens
  chr9:100619802-100620097
  hyper
gtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccgggccaggtgggaa

SEQ ID NO: 10003 - DNA, 426 bp, Homo sapiens; identical to SEQ ID NO: 3453
  chr9:100620357-100620783
  hyper

SEQ ID NO: 10004 - DNA, 47 bp, Homo sapiens
  chr9:101469203-101469250
  hyper
gataggaatgtcattcggaaatgatttcacaccgggttagccctgca

SEQ ID NO: 10005 - DNA, 315 bp, Homo sapiens
  chr9:101469527-101469842
  hyper
ggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtct

SEQ ID NO: 10006 - DNA, 134 bp, Homo sapiens
  chr9:101470116-101470250
  hyper
ggccccacacttgcccgcgcggagcgggctcagagctgctggcgcgcaccaggcgcccagccacgctgcacgctcaagccccttgggttccggagccttccggacctcaaagcgcggctcggcttccctggggg

SEQ ID NO: 10007 - DNA, 369 bp, Homo sapiens
  chr9:101470868-101471237
  hyper
gcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtg

SEQ ID NO: 10008 - DNA, 47 bp, Homo sapiens
  chr9:101471465-101471512
  hyper
tgctcaggggcggctcgggccgcctccagggacggggacgagccgtg

SEQ ID NO: 10009 - DNA, 87 bp, Homo sapiens; identical to SEQ ID NO: 3454
  chr9:101706109-101706196
  hyper

SEQ ID NO: 10010 - DNA, 467 bp, Homo sapiens; identical to SEQ ID NO: 3455
  chr9:101706312-101706779
  hyper

SEQ ID NO: 10011 - DNA, 92 bp, Homo sapiens
  chr9:102586697-102586789
  hyper
gggagacgggaagcacgtgctacagccgtgggaagatccgcttctacccgcgctacatcgagcgcaagctttccgtccgagcagctccagct

SEQ ID NO: 10012 - DNA, 30 bp, Homo sapiens
  chr9:103790612-103790642
  hyper
cgcatctcggttgcccgcagggtagaaagc

SEQ ID NO: 10013 - DNA, 46 bp, Homo sapiens
  chr9:104248563-104248609
  hyper
cctcagtttcccacccgtaggccgagctgaccgtctccatcgctgc

SEQ ID NO: 10014 - DNA, 61 bp, Homo sapiens
  chr9:104500256-104500317
  hyper
ctcattactgagacccgcagggagaaagcgcgccccctcctgcgcccggctcgcccctctg

SEQ ID NO: 10015 - DNA, 174 bp, Homo sapiens
  chr9:104500856-104501030
  hyper
tctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgc

SEQ ID NO: 10016 - DNA, 193 bp, Homo sapiens
  chr9:104501031-104501224
  hyper
ctaaacgcccactgttggtgagattcccgagtggcacatcccgcgcccctggaaagtcctctcccctcaaaggctgggcgtcatagtttgcaaaattccctaaaacctaagaaggaaaataggactatgagccggtgagaattctgaattcagagtcgcacctgagggatctgaaattcggtggttcactgaa

SEQ ID NO: 10017 - DNA, 460 bp, Homo sapiens
  chr9:108418487-108418947
  hyper
ggtgtcctataaaggcggcggcggcggcggcgcggtgtccaggcgagggcgcacacggccggcgagggcgacggctacggcgacgacgcgggctctttgcgaggaggtgcgtggactccggggggacatgggcgcaaccagggccgggctcgtgggcctgcgggtctctcgctgagccatactcacccgggagagcaggaatgcggcggagacttggtagcggccaccgagccaattcggtgggaagaccgggggactttccgcggggcaggggcggtggctcagctccgggggtgctaggccgactctctagcgtgttggcgggcccgcgtcgcttttatgcgtgatgccggggacccccttgtaccgctctcggcggcgcatctcccagagcccttcaaggagctcgcgcgtccccgagcgactcccggacacctggcagattcgaaacttcagccac

SEQ ID NO: 10018 - DNA, 153 bp, Homo sapiens
  chr9:109623063-109623216
  hyper
cgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 10019 - DNA, 170 bp, Homo sapiens
  chr9:110227815-110227985
  hyper
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagca

SEQ ID NO: 10020 - DNA, 432 bp, Homo sapiens; identical to SEQ ID NO: 3456
  chr9:110228200-110228632
  hyper

SEQ ID NO: 10021 - DNA, 30 bp, Homo sapiens
  chr9:111929340-111929370
  hyper
gcaggcggcgggccccgtcagtagcagcag

SEQ ID NO: 10022 - DNA, 86 bp, Homo sapiens
  chr9:112402752-112402838
  hyper
cttctccccaggctccgcgccgcgccgccagtcccaggggagccgccggcgcacctggcgcctagggcgcacggcactgcgcgctg

SEQ ID NO: 10023 - DNA, 79 bp, Homo sapiens
  chr9:112403209-112403288
  hyper
gcggcaggcagatcccgctcgggtccgcgtccaggatgggtgtttaatttcagccccgtgtgtacgcctggtgtttcta

SEQ ID NO: 10024 - DNA, 99 bp, Homo sapiens
  chr9:112542259-112542358
  hyper
agccgtgcgccccagcggctcgccgtgcgcccgcgccccaggtgcccactggctcgcgcgccctccgtctgcgccttggagacccgcggcggcgatcgc

SEQ ID NO: 10025 - DNA, 100 bp, Homo sapiens
  chr9:113341522-113341622
  hyper
tgcggaagttgacttcgcccacgctggacgaatcatccaccaggaagacaagctccaggcgctcgctgagctcccgcagcagccgcacgcgtcgccggaa

SEQ ID NO: 10026 - DNA, 78 bp, Homo sapiens
  chr9:113341679-113341757
  hyper
cgcggggatactcccgggggccccgggcgcggtctcggggaagaggcggaagctgaaattgcgcgacggggacatctg

SEQ ID NO: 10027 - DNA, 30 bp, Homo sapiens
  chr9:113801304-113801334
  hyper
aaactttccagaaggcgcaaagtttctccc

SEQ ID NO: 10028 - DNA, 136 bp, Homo sapiens
  chr9:114287491-114287627
  hyper
tctggaagctctttgcggtggcgttggtgctgtttgcggatgctgatgcaggtactggtcgtcccgggccccgagtttcggggccgtggccgggtcgccggctccgagggcgcacttggggcgggatgggggccgg

SEQ ID NO: 10029 - DNA, 96 bp, Homo sapiens
  chr9:114288004-114288100
  hyper
taaactccctgtagacggagccgagtgtcttagtcatcgcggagccccaggtgctcagcacggcgccaggtacgtggtgggcgcctaatatttggc

SEQ ID NO: 10030 - DNA, 517 bp, Homo sapiens
  chr9:115653040-115653557
  hyper
ctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 10031 - DNA, 147 bp, Homo sapiens
  chr9:118916648-118916795
  hyper
cggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgcc

SEQ ID NO: 10032 - DNA, 30 bp, Homo sapiens
  chr9:118917350-118917380
  hyper
ggacttagaagtcctcgaagtgccccaaag

SEQ ID NO: 10033 - DNA, 268 bp, Homo sapiens
  chr9:120175564-120175832
  hyper
cggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagct

SEQ ID NO: 10034 - DNA, 30 bp, Homo sapiens
  chr9:120176040-120176070
  hyper
gctgcaaggacaaaccggctctctgcctgg

SEQ ID NO: 10035 - DNA, 496 bp, Homo sapiens
  chr9:120176825-120177321
  hyper
tgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccagga

SEQ ID NO: 10036 - DNA, 95 bp, Homo sapiens; identical to SEQ ID NO: 3457
  chr9:120177898-120177993
  hyper

SEQ ID NO: 10037 - DNA, 30 bp, Homo sapiens
  chr9:122131178-122131208
  hyper
gagaagacttggaggcggcggggcggccag

SEQ ID NO: 10038 - DNA, 188 bp, Homo sapiens
  chr9:122131838-122132026
  hyper
gagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgca

SEQ ID NO: 10039 - DNA, 112 bp, Homo sapiens
  chr9:122132051-122132163
  hyper
cgcgcaaacccggaatcctggtgcccttaagcgtgactgtactgtgtgtgtcgcgagtacctgagtgtttctggggcggcaggtgtttccacggccgcgtggatccatcgag

SEQ ID NO: 10040 - DNA, 36 bp, Homo sapiens
  chr9:124990570-124990606
  hyper
cggcgcgccgggtaccggccccgcgtcgggattctc

SEQ ID NO: 10041 - DNA, 710 bp, Homo sapiens
  chr9:126770648-126771358
  hyper
aagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgt

SEQ ID NO: 10042 - DNA, 65 bp, Homo sapiens
  chr9:126771675-126771740
  hyper
gggggagtggaaagtcgcagggtgtgtttccacgtttcttgagcagcccgcggcaagagttgctg

SEQ ID NO: 10043 - DNA, 286 bp, Homo sapiens
  chr9:126773494-126773780
  hyper
cccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 10044 - DNA, 51 bp, Homo sapiens
  chr9:126774198-126774249
  hyper
cttcagggtgaaccccgaccgcagccgtcgccgcctcgggcagagtttgcg

SEQ ID NO: 10045 - DNA, 66 bp, Homo sapiens; identical to SEQ ID NO: 3458
  chr9:126774554-126774620
  hyper

SEQ ID NO: 10046 - DNA, 92 bp, Homo sapiens; identical to SEQ ID NO: 3459
  chr9:126777655-126777747
  hyper

SEQ ID NO: 10047 - DNA, 46 bp, Homo sapiens
  chr9:126778450-126778496
  hyper
cggaagcgagccccccgggcggggacgagaccggagcaggcctggc

SEQ ID NO: 10048 - DNA, 423 bp, Homo sapiens; identical to SEQ ID NO: 3460
  chr9:126779621-126780044
  hyper

SEQ ID NO: 10049 - DNA, 31 bp, Homo sapiens; identical to SEQ ID NO: 3461
  chr9:126780284-126780315
  hyper

SEQ ID NO: 10050 - DNA, 30 bp, Homo sapiens
  chr9:126780564-126780594
  hyper
aggagagagaaagcccgggtcctccccctc

SEQ ID NO: 10051 - DNA, 87 bp, Homo sapiens
  chr9:126780811-126780898
  hyper
ttttctctactcccccgccaataacggcttcggaaaaggcctcccccgcagggaccgggtctcccggagccccgggattcagctcgg

SEQ ID NO: 10052 - DNA, 30 bp, Homo sapiens
  chr9:126781276-126781306
  hyper
ggcccaaagataccccgtagggaggctgcc

SEQ ID NO: 10053 - DNA, 83 bp, Homo sapiens
  chr9:126783416-126783499
  hyper
gtgaccagccatacccgagcagccagaagaccaagcgcatgcgcacgtccttcaagcaccaccagcttcggaccatgaagtct

SEQ ID NO: 10054 - DNA, 133 bp, Homo sapiens
  chr9:126785171-126785304
  hyper
agccgagggagggagcgtcggccaatgggatgccgatgcgcccctctgggcccgcccctccctcatggtctgttttgctttggagtcccagtggcctgagctcctggtggatggagaacgtgactacactggc

SEQ ID NO: 10055 - DNA, 108 bp, Homo sapiens; identical to SEQ ID NO: 865
  chr9:127212898-127213006
  hyper

SEQ ID NO: 10056 - DNA, 150 bp, Homo sapiens; identical to SEQ ID NO: 3463
  chr9:127265875-127266025
  hyper

SEQ ID NO: 10057 - DNA, 242 bp, Homo sapiens
  chr9:127266346-127266588
  hyper
agagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 10058 - DNA, 219 bp, Homo sapiens
  chr9:127266628-127266847
  hyper
cggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgagg

SEQ ID NO: 10059 - DNA, 172 bp, Homo sapiens
  chr9:127266865-127267037
  hyper
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccgg

SEQ ID NO: 10060 - DNA, 91 bp, Homo sapiens
  chr9:127267360-127267451
  hyper
cgccggcaccctctccgcagtccagctcgagtcttcgccctcatcctccaggccccccagccgcagcccggctccccggaccccgagcgcg

SEQ ID NO: 10061 - DNA, 324 bp, Homo sapiens
  chr9:128651926-128652250
  hyper
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagca

SEQ ID NO: 10062 - DNA, 236 bp, Homo sapiens
  chr9:129276667-129276903
  hyper
gggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtg

SEQ ID NO: 10063 - DNA, 36 bp, Homo sapiens
  chr9:129372722-129372758
  hyper
ggcagctcatagagccgtgctcgagggaggcgggta

SEQ ID NO: 10064 - DNA, 30 bp, Homo sapiens
  chr9:129373250-129373280
  hyper
cgaaggacccgagaccggccaactcagctg

SEQ ID NO: 10065 - DNA, 85 bp, Homo sapiens
  chr9:129377159-129377244
  hyper
tagcaatcaccttggcgagcttgggagaggcgcaaggtcacctggggtgggggagattctaagagaaaaacgtctccctggtcac

SEQ ID NO: 10066 - DNA, 44 bp, Homo sapiens
  chr9:129377592-129377636
  hyper
ggtgcgaccgggacgccggggctgggccgggcggcgctgacggc

SEQ ID NO: 10067 - DNA, 188 bp, Homo sapiens
  chr9:129377772-129377960
  hyper
cggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggc

SEQ ID NO: 10068 - DNA, 15 bp, Homo sapiens
  chr9:129386182-129386197
  hyper
tccaggcccacctct

SEQ ID NO: 10069 - DNA, 4 bp, Homo sapiens
  chr9:129386429-129386433
  hyper
cgcg

SEQ ID NO: 10070 - DNA, 438 bp, Homo sapiens; identical to SEQ ID NO: 3464
  chr9:129387866-129388304
  hyper

SEQ ID NO: 10071 - DNA, 201 bp, Homo sapiens; identical to SEQ ID NO: 3465
  chr9:129389016-129389217
  hyper

SEQ ID NO: 10072 - DNA, 187 bp, Homo sapiens; identical to SEQ ID NO: 3466
  chr9:129400940-129401127
  hyper

SEQ ID NO: 10073 - DNA, 93 bp, Homo sapiens; identical to SEQ ID NO: 3467
  chr9:129445473-129445566
  hyper

SEQ ID NO: 10074 - DNA, 95 bp, Homo sapiens
  chr9:129445783-129445878
  hyper
tctagcagcagcagccgtgacccccagagtgtctagggtcctgtcgcctagctcctgtgaactgcagctcatccttcagccggcatcatcagagc

SEQ ID NO: 10075 - DNA, 240 bp, Homo sapiens
  chr9:130461691-130461931
  hyper
tgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 10076 - DNA, 319 bp, Homo sapiens
  chr9:131872526-131872845
  hyper
ttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 10077 - DNA, 30 bp, Homo sapiens
  chr9:131872856-131872886
  hyper
cgccgcggctggggtcggtgggtccttgct

SEQ ID NO: 10078 - DNA, 69 bp, Homo sapiens; identical to SEQ ID NO: 3468
  chr9:132382286-132382355
  hyper

SEQ ID NO: 10079 - DNA, 173 bp, Homo sapiens; identical to SEQ ID NO: 3469
  chr9:132382634-132382807
  hyper

SEQ ID NO: 10080 - DNA, 181 bp, Homo sapiens
  chr9:132428476-132428657
  hyper
ggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattc

SEQ ID NO: 10081 - DNA, 106 bp, Homo sapiens; identical to SEQ ID NO: 3470
  chr9:133308867-133308973
  hyper

SEQ ID NO: 10082 - DNA, 350 bp, Homo sapiens
  chr9:133534583-133534933
  hyper
gtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcc

SEQ ID NO: 10083 - DNA, 174 bp, Homo sapiens
  chr9:133535311-133535485
  hyper
cgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgc

SEQ ID NO: 10084 - DNA, 125 bp, Homo sapiens; identical to SEQ ID NO: 3471
  chr9:133535809-133535934
  hyper

SEQ ID NO: 10085 - DNA, 149 bp, Homo sapiens; identical to SEQ ID NO: 3472
  chr9:133535971-133536120
  hyper

SEQ ID NO: 10086 - DNA, 196 bp, Homo sapiens; identical to SEQ ID NO: 3473
  chr9:133536149-133536345
  hyper

SEQ ID NO: 10087 - DNA, 160 bp, Homo sapiens; identical to SEQ ID NO: 3474
  chr9:133536346-133536506
  hyper

SEQ ID NO: 10088 - DNA, 92 bp, Homo sapiens
  chr9:133536777-133536869
  hyper
tcaagtcctacgagccgcccacaatggaccgatatactgagggcctctctattaacgcccatgaatattaaagagatcgccaagtggcggcc

SEQ ID NO: 10089 - DNA, 299 bp, Homo sapiens
  chr9:133537070-133537369
  hyper
caccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagca

SEQ ID NO: 10090 - DNA, 264 bp, Homo sapiens
  chr9:133537606-133537870
  hyper
aactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacc

SEQ ID NO: 10091 - DNA, 238 bp, Homo sapiens; identical to SEQ ID NO: 3475
  chr9:133538169-133538407
  hyper

SEQ ID NO: 10092 - DNA, 525 bp, Homo sapiens; identical to SEQ ID NO: 3476
  chr9:133538655-133539180
  hyper

SEQ ID NO: 10093 - DNA, 37 bp, Homo sapiens
  chr9:133540453-133540490
  hyper
gcagcccacccggctcaaggaccgaccccggcgaccc

SEQ ID NO: 10094 - DNA, 357 bp, Homo sapiens
  chr9:133541108-133541465
  hyper
gcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 10095 - DNA, 742 bp, Homo sapiens; identical to SEQ ID NO: 866
  chr9:133541665-133542407
  hyper

SEQ ID NO: 10096 - DNA, 394 bp, Homo sapiens
  chr9:134151976-134152370
  hyper
tgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcct

SEQ ID NO: 10097 - DNA, 34 bp, Homo sapiens
  chr9:135285831-135285865
  hyper
tcagaaccctctcatcgtcaaggtgagcacccca

SEQ ID NO: 10098 - DNA, 169 bp, Homo sapiens
  chr9:135285880-135286049
  hyper
cgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcct

SEQ ID NO: 10099 - DNA, 107 bp, Homo sapiens
  chr9:135455044-135455151
  hyper
agagtaaatttcaaacgaaataaatcgcacagcacattttagatgataatagacggcggtaactcaatactaatgatagtgtactgacaacccgctaatagtcttgg

SEQ ID NO: 10100 - DNA, 617 bp, Homo sapiens; identical to SEQ ID NO: 3478
  chr9:135455407-135456024
  hyper

SEQ ID NO: 10101 - DNA, 83 bp, Homo sapiens
  chr9:135456827-135456910
  hyper
ctacatgggaaacaccgagagcccaacagaaatgccgcaaacaacataacttgaattttcttccccacactagaaaaggggtt

SEQ ID NO: 10102 - DNA, 383 bp, Homo sapiens
  chr9:135456970-135457353
  hyper
cacacttcttcctccgctggttttagtccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcaccccc

SEQ ID NO: 10103 - DNA, 122 bp, Homo sapiens; identical to SEQ ID NO: 3479
  chr9:135458477-135458599
  hyper

SEQ ID NO: 10104 - DNA, 91 bp, Homo sapiens; identical to SEQ ID NO: 3480
  chr9:135460069-135460160
  hyper

SEQ ID NO: 10105 - DNA, 271 bp, Homo sapiens; identical to SEQ ID NO: 3481
  chr9:135461541-135461812
  hyper

SEQ ID NO: 10106 - DNA, 275 bp, Homo sapiens; identical to SEQ ID NO: 867
  chr9:135462647-135462922
  hyper

SEQ ID NO: 10107 - DNA, 141 bp, Homo sapiens; identical to SEQ ID NO: 3483
  chr9:135464798-135464939
  hyper

SEQ ID NO: 10108 - DNA, 178 bp, Homo sapiens
  chr9:135465887-135466065
  hyper
ccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 10109 - DNA, 15 bp, Homo sapiens
  chr9:135466117-135466132
  hyper
cgcccagcgtccggc

SEQ ID NO: 10110 - DNA, 109 bp, Homo sapiens
  chr9:135466344-135466453
  hyper
ctggctgccccagaccgcagctctagcatctcaggggagaggggtttaagtcccgagtcagactcgaggcttccagttcacgtccaaagggccacggtcacctgagact

SEQ ID NO: 10111 - DNA, 64 bp, Homo sapiens
  chr9:135646011-135646075
  hyper
agagacctggggcagcgcggtgggcagcgggctgggccgagatcgagaccgggacaaggcaggg

SEQ ID NO: 10112 - DNA, 31 bp, Homo sapiens
  chr9:136474561-136474592
  hyper
cgcgcgcgcagtcgtcgggggatgccgggag

SEQ ID NO: 10113 - DNA, 37 bp, Homo sapiens
  chr9:137299217-137299254
  hyper
gctggcaggctgcagcgggaagcgcctgtgggtcctc

SEQ ID NO: 10114 - DNA, 144 bp, Homo sapiens; identical to SEQ ID NO: 3484
  chr9:137533823-137533967
  hyper

SEQ ID NO: 10115 - DNA, 87 bp, Homo sapiens; identical to SEQ ID NO: 3485
  chr9:137534065-137534152
  hyper

SEQ ID NO: 10116 - DNA, 136 bp, Homo sapiens
  chr9:137534360-137534496
  hyper
gtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggcc

SEQ ID NO: 10117 - DNA, 110 bp, Homo sapiens
  chr9:137979517-137979627
  hyper
ccggacggcgcttcccggtggcggcggaggagcccggagggacgcagccgggcaaggcagggcgcagggcgggcggcgcgaggcgcagggcgcggcgggcagaggccacc

SEQ ID NO: 10118 - DNA, 220 bp, Homo sapiens
  chr9:137980258-137980478
  hyper
agcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctggga

SEQ ID NO: 10119 - DNA, 246 bp, Homo sapiens
  chr9:137980714-137980960
  hyper
ccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgt

SEQ ID NO: 10120 - DNA, 95 bp, Homo sapiens; identical to SEQ ID NO: 3486
  chr9:138606154-138606249
  hyper

SEQ ID NO: 10121 - DNA, 200 bp, Homo sapiens
  chr9:138628543-138628743
  hyper
cggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 10122 - DNA, 142 bp, Homo sapiens; identical to SEQ ID NO: 3487
  chr9:139024749-139024891
  hyper

SEQ ID NO: 10123 - DNA, 54 bp, Homo sapiens
  chr9:139025663-139025717
  hyper
gagccaggctggcaccggacgcctcccgtggagacagcgcggggtcccggttcc

SEQ ID NO: 10124 - DNA, 408 bp, Homo sapiens
  chr9:139084662-139085070
  hyper
aaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggagga

SEQ ID NO: 10125 - DNA, 36 bp, Homo sapiens
  chr9:139085315-139085351
  hyper
ggctccccccaggcccgcgcggggcggaaccgggta

SEQ ID NO: 10126 - DNA, 161 bp, Homo sapiens
  chr9:139085372-139085533
  hyper
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgc

SEQ ID NO: 10127 - DNA, 73 bp, Homo sapiens
  chr9:139089123-139089196
  hyper
caggggcagctccctcgtgtgaggtgcagggtggagccgggcctgggtcagaactgagcgtggtctacctcat

SEQ ID NO: 10128 - DNA, 44 bp, Homo sapiens
  chr9:139089415-139089459
  hyper
caccgtaggggctgccgggacgcagctctcggtactgctctggg

SEQ ID NO: 10129 - DNA, 4 bp, Homo sapiens
  chr9:139090548-139090552
  hyper
tgtc

SEQ ID NO: 10130 - DNA, 156 bp, Homo sapiens
  chr9:139090586-139090742
  hyper
cggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcagggg

SEQ ID NO: 10131 - DNA, 454 bp, Homo sapiens
  chr9:139091071-139091525
  hyper
cgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacct

SEQ ID NO: 10132 - DNA, 100 bp, Homo sapiens
  chr9:139093823-139093923
  hyper
cgccccagcccaccccgcgccgcgcccgcgaccccagccttacgctgcatggcgactccagccctggcgggggctcctgtgtcagggatggcggggtcgg

SEQ ID NO: 10133 - DNA, 37 bp, Homo sapiens
  chr9:139094162-139094199
  hyper
cggctccagctggcccgggagtcgaggagaactgccc

SEQ ID NO: 10134 - DNA, 79 bp, Homo sapiens
  chr9:139094654-139094733
  hyper
caggcgcggacgttccggggtcctcgcgcccactcccgcccagatcctctagctcctgccagcctccgcggccaggccc

SEQ ID NO: 10135 - DNA, 7 bp, Homo sapiens
  chr9:139095014-139095021
  hyper
gccctgg

SEQ ID NO: 10136 - DNA, 200 bp, Homo sapiens
  chr9:139095285-139095485
  hyper
ctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 10137 - DNA, 445 bp, Homo sapiens
  chr9:139096598-139097043
  hyper
gcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacct

SEQ ID NO: 10138 - DNA, 183 bp, Homo sapiens
  chr9:139606480-139606663
  hyper
gaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagcc

SEQ ID NO: 10139 - DNA, 34 bp, Homo sapiens
  chr9:140024989-140025023
  hyper
ccctgccgaacctcacgcgcggcccctccctcat

SEQ ID NO: 10140 - DNA, 23 bp, Homo sapiens
  chr9:140033468-140033491
  hyper
gcgctccgacacacacgctcacg

SEQ ID NO: 10141 - DNA, 9 bp, Homo sapiens
  chr9:140033618-140033627
  hyper
cgtccggac

SEQ ID NO: 10142 - DNA, 382 bp, Homo sapiens; identical to SEQ ID NO: 3490
  chr9:140033762-140034144
  hyper

SEQ ID NO: 10143 - DNA, 141 bp, Homo sapiens
  chr9:140050956-140051097
  hyper
tcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcc

SEQ ID NO: 10144 - DNA, 272 bp, Homo sapiens
  chr9:140051219-140051491
  hyper
cgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggt

SEQ ID NO: 10145 - DNA, 91 bp, Homo sapiens; identical to SEQ ID NO: 3491
  chr9:140772120-140772211
  hyper

SEQ ID NO: 10146 - DNA, 545 bp, Homo sapiens; identical to SEQ ID NO: 868
  chr9:140772756-140773301
  hyper

SEQ ID NO: 10147 - DNA, 40 bp, Homo sapiens
  chr10:1778568-1778608
  hyper
gagtttgtcagtggccgctgtcagccggctgcttttcctg

SEQ ID NO: 10148 - DNA, 239 bp, Homo sapiens; identical to SEQ ID NO: 3493
  chr10:1778844-1779083
  hyper

SEQ ID NO: 10149 - DNA, 29 bp, Homo sapiens
  chr10:1779111-1779140
  hyper
cggagcagccatcccgccagcaccccaaa

SEQ ID NO: 10150 - DNA, 398 bp, Homo sapiens
  chr10:1779437-1779835
  hyper
ttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggcc

SEQ ID NO: 10151 - DNA, 195 bp, Homo sapiens
  chr10:1779836-1780031
  hyper
cttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaa

SEQ ID NO: 10152 - DNA, 30 bp, Homo sapiens
  chr10:3109104-3109134
  hyper
gctcggcccccacaacggcccgagcggccg

SEQ ID NO: 10153 - DNA, 121 bp, Homo sapiens; identical to SEQ ID NO: 869
  chr10:7450069-7450190
  hyper

SEQ ID NO: 10154 - DNA, 1772 bp, Homo sapiens; identical to SEQ ID NO: 870
  chr10:7450490-7452262
  hyper

SEQ ID NO: 10155 - DNA, 446 bp, Homo sapiens; identical to SEQ ID NO: 3497
  chr10:7452546-7452992
  hyper

SEQ ID NO: 10156 - DNA, 605 bp, Homo sapiens; identical to SEQ ID NO: 3498
  chr10:7453052-7453657
  hyper

SEQ ID NO: 10157 - DNA, 93 bp, Homo sapiens; identical to SEQ ID NO: 3499
  chr10:7453902-7453995
  hyper

SEQ ID NO: 10158 - DNA, 100 bp, Homo sapiens
  chr10:7454472-7454572
  hyper
ccgtgaggccccctgcgccgccagtatgggaagatcctgcctccttacaccttggagaacgctgggcgacgactaaagcgccttccgccggcctgtcact

SEQ ID NO: 10159 - DNA, 188 bp, Homo sapiens
  chr10:7708669-7708857
  hyper
cggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 10160 - DNA, 15 bp, Homo sapiens
  chr10:7708954-7708969
  hyper
cgcggtcccagcccg

SEQ ID NO: 10161 - DNA, 15 bp, Homo sapiens
  chr10:8075930-8075945
  hyper
gctggcagccaactt

SEQ ID NO: 10162 - DNA, 124 bp, Homo sapiens; identical to SEQ ID NO: 3501
  chr10:8076053-8076177
  hyper

SEQ ID NO: 10163 - DNA, 39 bp, Homo sapiens; identical to SEQ ID NO: 3502
  chr10:8076448-8076487
  hyper

SEQ ID NO: 10164 - DNA, 389 bp, Homo sapiens
  chr10:8076705-8077094
  hyper
cccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggc

SEQ ID NO: 10165 - DNA, 96 bp, Homo sapiens; identical to SEQ ID NO: 3503
  chr10:8077922-8078018
  hyper

SEQ ID NO: 10166 - DNA, 376 bp, Homo sapiens; identical to SEQ ID NO: 871
  chr10:8085599-8085975
  hyper

SEQ ID NO: 10167 - DNA, 81 bp, Homo sapiens
  chr10:8090494-8090575
  hyper
aagatgtccaaagcccgggagacccagggacgccggctgggctgcctccaccccttcttttcctcccgtggcacccacctg

SEQ ID NO: 10168 - DNA, 52 bp, Homo sapiens
  chr10:8091858-8091910
  hyper
cacggcccggtcctccggcttctctcctttgaacaggcgctggggacctccg

SEQ ID NO: 10169 - DNA, 6 bp, Homo sapiens
  chr10:8093458-8093464
  hyper
aagccc

SEQ ID NO: 10170 - DNA, 38 bp, Homo sapiens
  chr10:8093787-8093825
  hyper
gcgcctggcctggcccggacccccgcagcccggctctc

SEQ ID NO: 10171 - DNA, 105 bp, Homo sapiens
  chr10:8093859-8093964
  hyper
cgctcccttcccccttccttccccgtgggtcccgaggccgacctcggccctccctcctcggcatccccctcccatccttttcccttccccgctgccctgtgctcc

SEQ ID NO: 10172 - DNA, 6 bp, Homo sapiens
  chr10:8094252-8094258
  hyper
catccc

SEQ ID NO: 10173 - DNA, 72 bp, Homo sapiens
  chr10:8095387-8095459
  hyper
gcattttcgggccagcggctgcagccacccgggcgccgctaggggatgcagtggctcaaaggaccgagcggg

SEQ ID NO: 10174 - DNA, 186 bp, Homo sapiens
  chr10:8095492-8095678
  hyper
cgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggg

SEQ ID NO: 10175 - DNA, 73 bp, Homo sapiens
  chr10:8096204-8096277
  hyper
taataatgatccatgcgtgcctattttttaaaagtctgaaaaagaaaattctgcccatcgaaatgaacttcat

SEQ ID NO: 10176 - DNA, 89 bp, Homo sapiens; identical to SEQ ID NO: 3505
  chr10:8097108-8097197
  hyper

SEQ ID NO: 10177 - DNA, 41 bp, Homo sapiens
  chr10:8374499-8374540
  hyper
tggtcatgaggagagcggcagcatctcggtagtgatgggaa

SEQ ID NO: 10178 - DNA, 172 bp, Homo sapiens; identical to SEQ ID NO: 3506
  chr10:11059492-11059664
  hyper

SEQ ID NO: 10179 - DNA, 120 bp, Homo sapiens; identical to SEQ ID NO: 3507
  chr10:11059932-11060052
  hyper

SEQ ID NO: 10180 - DNA, 121 bp, Homo sapiens
  chr10:11060314-11060435
  hyper
ggcggtgcagggcgcggggcttcccggagggacgagcggagcgcggcgtcccggggaccgggcggggtccgcgagtccgggtgaggaccagcgggccgagcgcggcgtcccgggtccccgc

SEQ ID NO: 10181 - DNA, 217 bp, Homo sapiens
  chr10:13043317-13043534
  hyper
ggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgc

SEQ ID NO: 10182 - DNA, 33 bp, Homo sapiens; identical to SEQ ID NO: 3508
  chr10:13933506-13933539
  hyper

SEQ ID NO: 10183 - DNA, 339 bp, Homo sapiens; identical to SEQ ID NO: 3509
  chr10:13933596-13933935
  hyper

SEQ ID NO: 10184 - DNA, 14 bp, Homo sapiens
  chr10:13933982-13933996
  hyper
cgccaccgcccgcc

SEQ ID NO: 10185 - DNA, 129 bp, Homo sapiens; identical to SEQ ID NO: 3511
  chr10:13933997-13934126
  hyper

SEQ ID NO: 10186 - DNA, 75 bp, Homo sapiens; identical to SEQ ID NO: 3512
  chr10:13934168-13934243
  hyper

SEQ ID NO: 10187 - DNA, 125 bp, Homo sapiens
  chr10:14215748-14215873
  hyper
ggctgtctaatcaaccgagaggcgaactcatttactgaggttcccattgtccacgctgacagatggctcgctcccctctctgctctccccttcccctcagatcgcgctgccgtgcaggcaagcct

SEQ ID NO: 10188 - DNA, 858 bp, Homo sapiens; identical to SEQ ID NO: 872
  chr10:15760996-15761854
  hyper

SEQ ID NO: 10189 - DNA, 111 bp, Homo sapiens; identical to SEQ ID NO: 873
  chr10:15761855-15761966
  hyper

SEQ ID NO: 10190 - DNA, 81 bp, Homo sapiens; identical to SEQ ID NO: 3515
  chr10:16562545-16562626
  hyper

SEQ ID NO: 10191 - DNA, 46 bp, Homo sapiens; identical to SEQ ID NO: 3516
  chr10:16562627-16562673
  hyper

SEQ ID NO: 10192 - DNA, 956 bp, Homo sapiens; identical to SEQ ID NO: 3517
  chr10:16562709-16563665
  hyper

SEQ ID NO: 10193 - DNA, 261 bp, Homo sapiens; identical to SEQ ID NO: 3518
  chr10:16563690-16563951
  hyper

SEQ ID NO: 10194 - DNA, 32 bp, Homo sapiens; identical to SEQ ID NO: 3519
  chr10:17271223-17271255
  hyper

SEQ ID NO: 10195 - DNA, 76 bp, Homo sapiens; identical to SEQ ID NO: 3520
  chr10:17271443-17271519
  hyper

SEQ ID NO: 10196 - DNA, 221 bp, Homo sapiens; identical to SEQ ID NO: 3521
  chr10:17271520-17271741
  hyper

SEQ ID NO: 10197 - DNA, 102 bp, Homo sapiens
  chr10:17495534-17495636
  hyper
gcccgcgctgggcgccgctgtacctgttagtggcgcgcggtaccgcggtcgccgggctccggagcgtcctcagcgctgcgggggtgccgtgggtggcctccc

SEQ ID NO: 10198 - DNA, 300 bp, Homo sapiens
  chr10:17496544-17496844
  hyper
ggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaaactgtgcagtcgcttggctggatcctcccacgcatgaagaaagct

SEQ ID NO: 10199 - DNA, 33 bp, Homo sapiens
  chr10:18429760-18429793
  hyper
gggggcgctcggagccgccgcacaggtagcgag

SEQ ID NO: 10200 - DNA, 55 bp, Homo sapiens
  chr10:18430183-18430238
  hyper
cgctttctacgatgccgactctcctggccacgctccgagccggggtgggcgtggg

SEQ ID NO: 10201 - DNA, 33 bp, Homo sapiens
  chr10:20105577-20105610
  hyper
atctggggcaggcagcggcgctggctgtggaat

SEQ ID NO: 10202 - DNA, 30 bp, Homo sapiens
  chr10:20106628-20106658
  hyper
gtgacctgggccaagcgggcgctggaaggg

SEQ ID NO: 10203 - DNA, 59 bp, Homo sapiens
  chr10:21783695-21783754
  hyper
gcgcgcggactcggcttccccaggtcaggacccactaggtgggccgctcggccccaagc

SEQ ID NO: 10204 - DNA, 189 bp, Homo sapiens
  chr10:21805109-21805298
  hyper
cgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggt

SEQ ID NO: 10205 - DNA, 30 bp, Homo sapiens
  chr10:22518011-22518041
  hyper
gaaatacatgcatttcggtggccccgttac

SEQ ID NO: 10206 - DNA, 615 bp, Homo sapiens; identical to SEQ ID NO: 874
  chr10:22541236-22541851
  hyper

SEQ ID NO: 10207 - DNA, 226 bp, Homo sapiens; identical to SEQ ID NO: 875
  chr10:22542024-22542250
  hyper

SEQ ID NO: 10208 - DNA, 560 bp, Homo sapiens; identical to SEQ ID NO: 876
  chr10:22624561-22625121
  hyper

SEQ ID NO: 10209 - DNA, 401 bp, Homo sapiens; identical to SEQ ID NO: 877
  chr10:22625382-22625783
  hyper

SEQ ID NO: 10210 - DNA, 292 bp, Homo sapiens; identical to SEQ ID NO: 878
  chr10:22625811-22626103
  hyper

SEQ ID NO: 10211 - DNA, 190 bp, Homo sapiens; identical to SEQ ID NO: 879
  chr10:22633985-22634175
  hyper

SEQ ID NO: 10212 - DNA, 108 bp, Homo sapiens; identical to SEQ ID NO: 880
  chr10:22634324-22634432
  hyper

SEQ ID NO: 10213 - DNA, 6 bp, Homo sapiens
  chr10:22634433-22634439
  hyper
gctccc

SEQ ID NO: 10214 - DNA, 215 bp, Homo sapiens; identical to SEQ ID NO: 882
  chr10:22634440-22634655
  hyper

SEQ ID NO: 10215 - DNA, 897 bp, Homo sapiens; identical to SEQ ID NO: 883
  chr10:22764693-22765590
  hyper

SEQ ID NO: 10216 - DNA, 274 bp, Homo sapiens; identical to SEQ ID NO: 3532
  chr10:23216856-23217130
  hyper

SEQ ID NO: 10217 - DNA, 322 bp, Homo sapiens
  chr10:23461301-23461623
  hyper
gactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccaga

SEQ ID NO: 10218 - DNA, 99 bp, Homo sapiens
  chr10:23462209-23462308
  hyper
tctctgaaagggcagcgcaccccctcccgaccgctagcagcacaagtggcgacattcccatggagcggccgcgccgcagcttgccgcattcagcgcgga

SEQ ID NO: 10219 - DNA, 91 bp, Homo sapiens; identical to SEQ ID NO: 3533
  chr10:23462524-23462615
  hyper

SEQ ID NO: 10220 - DNA, 298 bp, Homo sapiens; identical to SEQ ID NO: 3534
  chr10:23462634-23462932
  hyper

SEQ ID NO: 10221 - DNA, 588 bp, Homo sapiens; identical to SEQ ID NO: 3535
  chr10:23463266-23463854
  hyper

SEQ ID NO: 10222 - DNA, 190 bp, Homo sapiens; identical to SEQ ID NO: 3536
  chr10:23463887-23464077
  hyper

SEQ ID NO: 10223 - DNA, 124 bp, Homo sapiens
  chr10:23480002-23480126
  hyper
gcttctgaactctcccggggtggaagctgcagcctggcttttaaccggaattgcccagaccttgaaagtgtttctttgttgctcttaaaaagaggaattcacgttgcatcgcagtctgtgataa

SEQ ID NO: 10224 - DNA, 204 bp, Homo sapiens
  chr10:23480383-23480587
  hyper
tgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagt

SEQ ID NO: 10225 - DNA, 35 bp, Homo sapiens
  chr10:23481015-23481050
  hyper
ggagagggaagagagcggtgcgaggagccccgggc

SEQ ID NO: 10226 - DNA, 82 bp, Homo sapiens
  chr10:23481303-23481385
  hyper
gggcactccagggaggcccgggggcgggcagcccggcggccgcctagctgcccccagccagggccccgggagggaggggctc

SEQ ID NO: 10227 - DNA, 400 bp, Homo sapiens
  chr10:23481386-23481786
  hyper
gacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggc

SEQ ID NO: 10228 - DNA, 179 bp, Homo sapiens
  chr10:23481787-23481966
  hyper
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaac

SEQ ID NO: 10229 - DNA, 6 bp, Homo sapiens
  chr10:23482227-23482233
  hyper
tgccat

SEQ ID NO: 10230 - DNA, 172 bp, Homo sapiens
  chr10:23482288-23482460
  hyper
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccaga

SEQ ID NO: 10231 - DNA, 734 bp, Homo sapiens; identical to SEQ ID NO: 884
  chr10:23483777-23484511
  hyper

SEQ ID NO: 10232 - DNA, 30 bp, Homo sapiens
  chr10:23486384-23486414
  hyper
accgagtaccagctgcgaggttgaacaaac

SEQ ID NO: 10233 - DNA, 413 bp, Homo sapiens; identical to SEQ ID NO: 3538
  chr10:23487742-23488155
  hyper

SEQ ID NO: 10234 - DNA, 1097 bp, Homo sapiens; identical to SEQ ID NO: 885
  chr10:23488393-23489490
  hyper

SEQ ID NO: 10235 - DNA, 55 bp, Homo sapiens
  chr10:23633401-23633456
  hyper
ggaaagctgcacccccgtaaataacccttcagcctcccgccgtgcccctggaccc

SEQ ID NO: 10236 - DNA, 886 bp, Homo sapiens; identical to SEQ ID NO: 886
  chr10:23982394-23983280
  hyper

SEQ ID NO: 10237 - DNA, 190 bp, Homo sapiens
  chr10:23983617-23983807
  hyper
cgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggt

SEQ ID NO: 10238 - DNA, 83 bp, Homo sapiens; identical to SEQ ID NO: 3541
  chr10:23984130-23984213
  hyper

SEQ ID NO: 10239 - DNA, 240 bp, Homo sapiens
  chr10:23984535-23984775
  hyper
actaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 10240 - DNA, 146 bp, Homo sapiens
  chr10:23984841-23984987
  hyper
cgacagcgcccgggagcagggtgacccccacagcggccggccttccggctggctgccctccccgctcgccgctctccccgcgccgctgcgggtcctccgagaccccggactgtcctgagctgcttcgagggcgggcgagaccctgt

SEQ ID NO: 10241 - DNA, 137 bp, Homo sapiens
  chr10:25464619-25464756
  hyper
tcccaccagctgaagcgagccaactgctccggccgctacgagttggcgggcctgccggggaagtggccagccctggccagcgcgcacccctccttgcaccgggcgctggacacactgacacacgccaccaacttcct

SEQ ID NO: 10242 - DNA, 147 bp, Homo sapiens; identical to SEQ ID NO: 3542
  chr10:25465203-25465350
  hyper

SEQ ID NO: 10243 - DNA, 204 bp, Homo sapiens; identical to SEQ ID NO: 3543
  chr10:25465351-25465555
  hyper

SEQ ID NO: 10244 - DNA, 140 bp, Homo sapiens
  chr10:26055811-26055951
  hyper
gatgccattatcagccgccaacagatggagcctatctgcgcgctgtcaatcatcccccacctgtggatcgcgcagcccagccaaaaaattaattgcttagaaatataaaatcggtggactcagatcggaaaggattagga

SEQ ID NO: 10245 - DNA, 30 bp, Homo sapiens
  chr10:26223157-26223187
  hyper
agttcttcccctgctcggctgcccctgccc

SEQ ID NO: 10246 - DNA, 104 bp, Homo sapiens
  chr10:26223766-26223870
  hyper
aacaggaggagggaacgggaagggtggcgtaaggggtgaaggaagatctttaggggtgaacttgggaaggaaacgtaaggggaggacctcgaagagtaacgagg

SEQ ID NO: 10247 - DNA, 279 bp, Homo sapiens; identical to SEQ ID NO: 887
  chr10:26500592-26500871
  hyper

SEQ ID NO: 10248 - DNA, 30 bp, Homo sapiens
  chr10:26501132-26501162
  hyper
cctttctcaccagcccgccagttgtggcaa

SEQ ID NO: 10249 - DNA, 39 bp, Homo sapiens
  chr10:26501446-26501485
  hyper
gtgccttggaaaacccgtggtttgcgtgactgatccctc

SEQ ID NO: 10250 - DNA, 130 bp, Homo sapiens; identical to SEQ ID NO: 3545
  chr10:26504014-26504144
  hyper

SEQ ID NO: 10251 - DNA, 694 bp, Homo sapiens; identical to SEQ ID NO: 3546
  chr10:26504190-26504884
  hyper

SEQ ID NO: 10252 - DNA, 200 bp, Homo sapiens; identical to SEQ ID NO: 3547
  chr10:26505008-26505208
  hyper

SEQ ID NO: 10253 - DNA, 65 bp, Homo sapiens
  chr10:26505553-26505618
  hyper
acacacgcacagacacgcacgttttctgttcctgcgtgacacccgccctcgccgctcggccccgc

SEQ ID NO: 10254 - DNA, 90 bp, Homo sapiens; identical to SEQ ID NO: 3548
  chr10:26506073-26506163
  hyper

SEQ ID NO: 10255 - DNA, 246 bp, Homo sapiens; identical to SEQ ID NO: 888
  chr10:26506373-26506619
  hyper

SEQ ID NO: 10256 - DNA, 518 bp, Homo sapiens; identical to SEQ ID NO: 889
  chr10:26506902-26507420
  hyper

SEQ ID NO: 10257 - DNA, 89 bp, Homo sapiens
  chr10:26727302-26727391
  hyper
ccttagtccctcttgcgtcgaggctgcaaaatggttccattcgccaggagacgctcctgagagaagggcgcgcgcggcacaggtagggg

SEQ ID NO: 10258 - DNA, 200 bp, Homo sapiens; identical to SEQ ID NO: 890
  chr10:26727617-26727817
  hyper

SEQ ID NO: 10259 - DNA, 183 bp, Homo sapiens; identical to SEQ ID NO: 891
  chr10:26727867-26728050
  hyper

SEQ ID NO: 10260 - DNA, 606 bp, Homo sapiens; identical to SEQ ID NO: 3553
  chr10:27547726-27548332
  hyper

SEQ ID NO: 10261 - DNA, 15 bp, Homo sapiens
  chr10:27548400-27548415
  hyper
cgaatccattcttgg

SEQ ID NO: 10262 - DNA, 33 bp, Homo sapiens
  chr10:28030892-28030925
  hyper
ggtcaggggaaaggtcgccgactggacataggg

SEQ ID NO: 10263 - DNA, 173 bp, Homo sapiens
  chr10:28032490-28032663
  hyper
ggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcc

SEQ ID NO: 10264 - DNA, 54 bp, Homo sapiens
  chr10:28032966-28033020
  hyper
tcgtgttttctagatcgtggatggtttggttgaaacccccgcatcttctgtccg

SEQ ID NO: 10265 - DNA, 40 bp, Homo sapiens
  chr10:28033410-28033450
  hyper
tgagcctctgcctgccgcgcaccggcgtcaggagcaagtc

SEQ ID NO: 10266 - DNA, 83 bp, Homo sapiens
  chr10:28033790-28033873
  hyper
gctacggtctgtgttcgtagggaagtgaagtcagacctctgctggatgtcgtgtgtcccctaggactgcgtcctcccgcgcag

SEQ ID NO: 10267 - DNA, 123 bp, Homo sapiens
  chr10:28034396-28034519
  hyper
gtccccctcccccaacgccggcgaataattttaaagcaaaggaggcgcggccaggtgggctcccaagctccgcgcagacccttgggccagccttggccgctacccgagcgcctctccaccaga

SEQ ID NO: 10268 - DNA, 391 bp, Homo sapiens; identical to SEQ ID NO: 3555
  chr10:28034909-28035300
  hyper

SEQ ID NO: 10269 - DNA, 45 bp, Homo sapiens
  chr10:28035615-28035660
  hyper
gcttcctaacattaccgcaaatataagtagcgaaagcggcggttt

SEQ ID NO: 10270 - DNA, 378 bp, Homo sapiens
  chr10:28287828-28288206
  hyper
gaggcctacagggcccgtgccctcccccgggcgccgccgccgccgccttccgctcccagcctcacccggccgcgaccgcagcccagtccgttaccctggtctcgggacctccgcgcatccaagattcccgcggacccgttgcaccgtatgcccgcgccagagacgctctgcgcccgcgctgggttccacccgccccggccacctgctgctttccgctcggcccctcccgggaaacacttttattcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 10271 - DNA, 355 bp, Homo sapiens
  chr10:28957640-28957995
  hyper
gagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 10272 - DNA, 15 bp, Homo sapiens
  chr10:28958043-28958058
  hyper
cgatctttttggatg

SEQ ID NO: 10273 - DNA, 30 bp, Homo sapiens
  chr10:28965689-28965719
  hyper
attgagtgtcagtctcggccagtgtcgtct

SEQ ID NO: 10274 - DNA, 124 bp, Homo sapiens
  chr10:29011038-29011162
  hyper
agctgtttagacaaacgggctcagcgctccggagccgcgcgggcctccaaatgcaagggtttgttctgctggggcagcgtctgtcgcgaaagcagcggcggggaggaagcgcagagctgtgttt

SEQ ID NO: 10275 - DNA, 14 bp, Homo sapiens
  chr10:30026076-30026090
  hyper
gcttaccctggagc

SEQ ID NO: 10276 - DNA, 47 bp, Homo sapiens
  chr10:31608931-31608978
  hyper
ggtaaagttgggacccgcgggccgggcgcgctcgcgtaacggggatt

SEQ ID NO: 10277 - DNA, 81 bp, Homo sapiens
  chr10:31609959-31610040
  hyper
cgtctataatgggaccgctgcagcgtcgagaaaacgaggaaatacgtgtttaggagaaaactctctcgtgctcccccagcc

SEQ ID NO: 10278 - DNA, 41 bp, Homo sapiens
  chr10:43248734-43248775
  hyper
tcccccaggcaaaggcgccgccggcgcgtccagcgcggcct

SEQ ID NO: 10279 - DNA, 175 bp, Homo sapiens
  chr10:43249944-43250119
  hyper
caggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 10280 - DNA, 15 bp, Homo sapiens
  chr10:43250136-43250151
  hyper
cggggagggagcgtg

SEQ ID NO: 10281 - DNA, 374 bp, Homo sapiens; identical to SEQ ID NO: 3556
  chr10:43250406-43250780
  hyper

SEQ ID NO: 10282 - DNA, 39 bp, Homo sapiens; identical to SEQ ID NO: 3557
  chr10:43250854-43250893
  hyper

SEQ ID NO: 10283 - DNA, 78 bp, Homo sapiens
  chr10:43393565-43393643
  hyper
cgcttcagcctctagcgacccagcgggggcgcgacttccgagccgcctccgcctcccgcctctaccgcggggccgggg

SEQ ID NO: 10284 - DNA, 30 bp, Homo sapiens
  chr10:43428424-43428454
  hyper
agtctcagcgggttccggcttagtccggca

SEQ ID NO: 10285 - DNA, 92 bp, Homo sapiens; identical to SEQ ID NO: 892
  chr10:43429066-43429158
  hyper

SEQ ID NO: 10286 - DNA, 77 bp, Homo sapiens; identical to SEQ ID NO: 3559
  chr10:43429361-43429438
  hyper

SEQ ID NO: 10287 - DNA, 192 bp, Homo sapiens
  chr10:43571989-43572181
  hyper
gcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcg

SEQ ID NO: 10288 - DNA, 30 bp, Homo sapiens
  chr10:43600564-43600594
  hyper
acgaggacgactcggcgcccaccttccccg

SEQ ID NO: 10289 - DNA, 60 bp, Homo sapiens
  chr10:43697887-43697947
  hyper
ccctcttggctgaaacgactccgaccctctcggaagatgcccgcgcggcctctgcccccg

SEQ ID NO: 10290 - DNA, 67 bp, Homo sapiens
  chr10:43724529-43724596
  hyper
gcctgcaccctacagcgccctcgccctggagcgcacactcctcgaagccccacggtgggctccactc

SEQ ID NO: 10291 - DNA, 117 bp, Homo sapiens
  chr10:44185390-44185507
  hyper
gcccttctcgtctcccgccgggctcactctttcgcattttgctgcgaaagtttactggaaataggtccattcactggtcgattcagagggacactagaaacgcgatgcccatatcta

SEQ ID NO: 10292 - DNA, 164 bp, Homo sapiens
  chr10:44879926-44880090
  hyper
gcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctc

SEQ ID NO: 10293 - DNA, 78 bp, Homo sapiens
  chr10:44880377-44880455
  hyper
gccgagcgcacttaccgtcgctgaggcagagcgcggtcagcacgaggaccagcacgaccacgaccttggcgttcatgg

SEQ ID NO: 10294 - DNA, 189 bp, Homo sapiens
  chr10:44880759-44880948
  hyper
ggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgag

SEQ ID NO: 10295 - DNA, 159 bp, Homo sapiens
  chr10:49731642-49731801
  hyper
gaatggtccctctcccggcagttaagccgcaggggcggcgcagggcgcgcgccgggctcgcggtgcagagacctgcgagcgggtctgggcgccgggggttcctccgtcccggccgtggacttggcggacctgcagccggcgccgcggccagccccgggc

SEQ ID NO: 10296 - DNA, 28 bp, Homo sapiens
  chr10:49732060-49732088
  hyper
ccgcagggagcggggcgcacgtgcgcgc

SEQ ID NO: 10297 - DNA, 160 bp, Homo sapiens; identical to SEQ ID NO: 3561
  chr10:49732155-49732315
  hyper

SEQ ID NO: 10298 - DNA, 227 bp, Homo sapiens; identical to SEQ ID NO: 3562
  chr10:49732316-49732543
  hyper

SEQ ID NO: 10299 - DNA, 340 bp, Homo sapiens
  chr10:50323347-50323687
  hyper
gacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 10300 - DNA, 205 bp, Homo sapiens
  chr10:50603003-50603208
  hyper
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcac

SEQ ID NO: 10301 - DNA, 261 bp, Homo sapiens; identical to SEQ ID NO: 3563
  chr10:50603909-50604170
  hyper

SEQ ID NO: 10302 - DNA, 30 bp, Homo sapiens
  chr10:50604615-50604645
  hyper
tttatgttcgcttctcgatgcaaatgatat

SEQ ID NO: 10303 - DNA, 1458 bp, Homo sapiens; identical to SEQ ID NO: 893
  chr10:50605213-50606671
  hyper

SEQ ID NO: 10304 - DNA, 38 bp, Homo sapiens
  chr10:50817080-50817118
  hyper
ctggagcctctctcccgccagtccgcccactggaacac

SEQ ID NO: 10305 - DNA, 30 bp, Homo sapiens
  chr10:50817434-50817464
  hyper
gaggctggcaggagccgagggagggcttgg

SEQ ID NO: 10306 - DNA, 460 bp, Homo sapiens
  chr10:50818152-50818612
  hyper
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacgg

SEQ ID NO: 10307 - DNA, 189 bp, Homo sapiens; identical to SEQ ID NO: 3565
  chr10:50821472-50821661
  hyper

SEQ ID NO: 10308 - DNA, 52 bp, Homo sapiens
  chr10:50822142-50822194
  hyper
cctaaatttgttgcccgagttcctccgggaagcgctccgggtagattctggg

SEQ ID NO: 10309 - DNA, 30 bp, Homo sapiens
  chr10:50887488-50887518
  hyper
gcacgccgcctgacacgaacttactgtgcc

SEQ ID NO: 10310 - DNA, 27 bp, Homo sapiens
  chr10:50887789-50887816
  hyper
cggcaggcctaccggtggagcaccaca

SEQ ID NO: 10311 - DNA, 196 bp, Homo sapiens
  chr10:50969916-50970112
  hyper
accctccccatcccccgcacagccctcgcagctccgggccctcccctggccacggaaggcgcggggcagtctgaagtcctcgggctggagaaacccaccgcgagcacccgctcctctgcgcaggaccctggactagccgggtggtacgcgcgcgatgggctgggggtcccgggggaggccacggccagccaaggtc

SEQ ID NO: 10312 - DNA, 88 bp, Homo sapiens
  chr10:52177735-52177823
  hyper
aattggcactgattgcggtattttaatcggttcacaccgtctgttagtgtattctaatgaaccacagcatctccggagcaacacttac

SEQ ID NO: 10313 - DNA, 30 bp, Homo sapiens
  chr10:52178275-52178305
  hyper
cagtgtcggttaaggcggaactttcctttc

SEQ ID NO: 10314 - DNA, 137 bp, Homo sapiens
  chr10:52750888-52751025
  hyper
gcctctcctctccatcgcttttagacttctcatcctcccctcggtgcttttagtccattcagcagaagcggatcgaagcaggaggctccccgcgccgcattaggggcgcactccgccgcgctcgagtacttagcgcc

SEQ ID NO: 10315 - DNA, 88 bp, Homo sapiens
  chr10:52833568-52833656
  hyper
agaggcaagtttcttcgcaagcgttagccacctgtgtgaggcgctctgggtgggaaaggtggcgtgggagaagcgacagctcggccac

SEQ ID NO: 10316 - DNA, 87 bp, Homo sapiens
  chr10:52834409-52834496
  hyper
gcgggatgctctcatcgacgagctggagctggagttggatcagaaggacgaactgatccagaagctgcagaacgagctggacaagta

SEQ ID NO: 10317 - DNA, 140 bp, Homo sapiens
  chr10:54068446-54068586
  hyper
aagtctgattaagaccgggggtccccaggccgtttgatcttcgctcatcaaagagagtctttaaacaagcttcattttacactactgtatgctagcgacgggttgtgacacccaagtgcagccaccgtgagcacccggca

SEQ ID NO: 10318 - DNA, 133 bp, Homo sapiens
  chr10:54073162-54073295
  hyper
acgttggaccctgtccgctttggtcccggccactttgatctcacgcgtctgcctaatcaagttcatctaccgccgcgattgccctgattcaaagaacaacattaaatggtttgattatcggatggtcatttcc

SEQ ID NO: 10319 - DNA, 89 bp, Homo sapiens
  chr10:57387425-57387514
  hyper
ctccttcagcagcagcggacgtagggatcccgagcagccacggagcttaggtcccgcagagagctcctgccaagcgcttctctctcgac

SEQ ID NO: 10320 - DNA, 30 bp, Homo sapiens
  chr10:57387755-57387785
  hyper
agcgagaaggcctggcggagatagcgcggg

SEQ ID NO: 10321 - DNA, 220 bp, Homo sapiens
  chr10:57388267-57388487
  hyper
gacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagc

SEQ ID NO: 10322 - DNA, 46 bp, Homo sapiens
  chr10:57389890-57389936
  hyper
aactggcaacagttacggcatttttgctctgcgaagaatacgccca

SEQ ID NO: 10323 - DNA, 30 bp, Homo sapiens
  chr10:57390376-57390406
  hyper
ggcggacgcaaccagcgcacccgcagacgg

SEQ ID NO: 10324 - DNA, 30 bp, Homo sapiens
  chr10:57390646-57390676
  hyper
cacacatccagtctccgggaacaaaactct

SEQ ID NO: 10325 - DNA, 94 bp, Homo sapiens
  chr10:57391255-57391349
  hyper
tccttcccaggaggccgattctctccatcccaactcgctccgtggctcctgcttgctcctgttccccctcccgactccccgggtaacagtcgac

SEQ ID NO: 10326 - DNA, 188 bp, Homo sapiens
  chr10:60272637-60272825
  hyper
cgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagtt

SEQ ID NO: 10327 - DNA, 149 bp, Homo sapiens
  chr10:60273130-60273279
  hyper
cctctaactccttttcggacatccccaccgcgcgctccggcgcccgctactccagcctacggccggccggtttagctccaggcccgctcccccgcggagccggaggacacccagggactggagacttcgcgggactccccacccttcca

SEQ ID NO: 10328 - DNA, 48 bp, Homo sapiens
  chr10:60936403-60936451
  hyper
gagccgcacactccgcggagctcctgccacagccgtcgccttcgcggc

SEQ ID NO: 10329 - DNA, 19 bp, Homo sapiens
  chr10:60936711-60936730
  hyper
ccgggacggtaagagcggc

SEQ ID NO: 10330 - DNA, 30 bp, Homo sapiens; identical to SEQ ID NO: 3566
  chr10:60937073-60937103
  hyper

SEQ ID NO: 10331 - DNA, 260 bp, Homo sapiens
  chr10:63212569-63212829
  hyper
cgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagacca

SEQ ID NO: 10332 - DNA, 92 bp, Homo sapiens
  chr10:63213120-63213212
  hyper
ggcgttattctccagcgctgcccatccccctcccaatctcggggccagtctccatccctgtccggtatccccgcccccgggcctctgtgagg

SEQ ID NO: 10333 - DNA, 250 bp, Homo sapiens
  chr10:64133867-64134117
  hyper
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagcc

SEQ ID NO: 10334 - DNA, 354 bp, Homo sapiens
  chr10:64574714-64575068
  hyper
gctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 10335 - DNA, 667 bp, Homo sapiens
  chr10:64575127-64575794
  hyper
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgct

SEQ ID NO: 10336 - DNA, 342 bp, Homo sapiens; identical to SEQ ID NO: 3567
  chr10:64578287-64578629
  hyper

SEQ ID NO: 10337 - DNA, 5 bp, Homo sapiens
  chr10:64578651-64578656
  hyper
cgagg

SEQ ID NO: 10338 - DNA, 39 bp, Homo sapiens
  chr10:71327725-71327764
  hyper
cgcctcactcccagacgcatctctcgcgctggatctacg

SEQ ID NO: 10339 - DNA, 154 bp, Homo sapiens
  chr10:71328773-71328927
  hyper
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaag

SEQ ID NO: 10340 - DNA, 102 bp, Homo sapiens
  chr10:71331570-71331672
  hyper
ggagggcaatggctccgaaaagtgcacgaggagaaggcagagggtcgccttcgtggctttaaggcagagtgaggcgccctgaaatcccggacctgattggga

SEQ ID NO: 10341 - DNA, 462 bp, Homo sapiens; identical to SEQ ID NO: 894
  chr10:71331980-71332442
  hyper

SEQ ID NO: 10342 - DNA, 230 bp, Homo sapiens
  chr10:71332821-71333051
  hyper
gggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctg

SEQ ID NO: 10343 - DNA, 57 bp, Homo sapiens
  chr10:71338223-71338280
  hyper
ggcatccacagaaaacgcgactgatgacacagatgcggagcgcgagatgcccatatg

SEQ ID NO: 10344 - DNA, 49 bp, Homo sapiens
  chr10:71562537-71562586
  hyper
tgttcagccggtgtccgcgggcgctcgctctctgcgagccccaggttcg

SEQ ID NO: 10345 - DNA, 51 bp, Homo sapiens
  chr10:71813722-71813773
  hyper
cccagcctccagccccggcgcacctcagccccagcccggccagccccccgg

SEQ ID NO: 10346 - DNA, 89 bp, Homo sapiens; identical to SEQ ID NO: 3570
  chr10:72015293-72015382
  hyper

SEQ ID NO: 10347 - DNA, 70 bp, Homo sapiens
  chr10:72043778-72043848
  hyper
cgccccgggcccgcctcccgcatggcgctctctccacagagcccgagcgcccctccgaagtaggggacac

SEQ ID NO: 10348 - DNA, 15 bp, Homo sapiens
  chr10:72200050-72200065
  hyper
gccccctcccatccc

SEQ ID NO: 10349 - DNA, 655 bp, Homo sapiens; identical to SEQ ID NO: 896
  chr10:72200117-72200772
  hyper

SEQ ID NO: 10350 - DNA, 557 bp, Homo sapiens; identical to SEQ ID NO: 897
  chr10:72200824-72201381
  hyper

SEQ ID NO: 10351 - DNA, 49 bp, Homo sapiens
  chr10:72431989-72432038
  hyper
agcagccatagaaagcggctttgggccaccactccggggatcccaggcg

SEQ ID NO: 10352 - DNA, 56 bp, Homo sapiens
  chr10:73156679-73156735
  hyper
cgcggacttgagcggcggcggcggctcgggagagagggacgcgggctgcaggcgcg

SEQ ID NO: 10353 - DNA, 135 bp, Homo sapiens
  chr10:73157113-73157248
  hyper
ccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccct

SEQ ID NO: 10354 - DNA, 30 bp, Homo sapiens
  chr10:73157660-73157690
  hyper
ggaagacgcgcccctcgaggagccgggagc

SEQ ID NO: 10355 - DNA, 72 bp, Homo sapiens; identical to SEQ ID NO: 3574
  chr10:73847720-73847792
  hyper

SEQ ID NO: 10356 - DNA, 14 bp, Homo sapiens
  chr10:73848208-73848222
  hyper
ggtgactggcggag

SEQ ID NO: 10357 - DNA, 15 bp, Homo sapiens
  chr10:75407398-75407413
  hyper
cagattctgcacccc

SEQ ID NO: 10358 - DNA, 189 bp, Homo sapiens
  chr10:75407477-75407666
  hyper
cgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagat

SEQ ID NO: 10359 - DNA, 30 bp, Homo sapiens
  chr10:77191554-77191584
  hyper
cgtggggagggacagcggggcacagaggct

SEQ ID NO: 10360 - DNA, 777 bp, Homo sapiens; identical to SEQ ID NO: 3576
  chr10:79396686-79397463
  hyper

SEQ ID NO: 10361 - DNA, 581 bp, Homo sapiens
  chr10:79398015-79398596
  hyper
ccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtg

SEQ ID NO: 10362 - DNA, 30 bp, Homo sapiens
  chr10:79470990-79471020
  hyper
agcagccgcagtccccgaaaggacccgtcc

SEQ ID NO: 10363 - DNA, 392 bp, Homo sapiens
  chr10:81664598-81664990
  hyper
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctg

SEQ ID NO: 10364 - DNA, 127 bp, Homo sapiens
  chr10:81892288-81892415
  hyper
ggcgcccaggtggcacgtcggtgcctcagctcccggggtctctgggctccgcgctgcccacggggtgccgaggggcctctggagggggcgggttctctcgagccagaaagtccggagccgcccagga

SEQ ID NO: 10365 - DNA, 329 bp, Homo sapiens
  chr10:82116699-82117028
  hyper
gcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcg

SEQ ID NO: 10366 - DNA, 246 bp, Homo sapiens
  chr10:83633868-83634114
  hyper
ccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggca

SEQ ID NO: 10367 - DNA, 282 bp, Homo sapiens
  chr10:83634933-83635215
  hyper
cgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacgg

SEQ ID NO: 10368 - DNA, 15 bp, Homo sapiens
  chr10:83635484-83635499
  hyper
ctaccacttccacca

SEQ ID NO: 10369 - DNA, 29 bp, Homo sapiens
  chr10:83635530-83635559
  hyper
cgcctcctccaggacgcccaaccggatta

SEQ ID NO: 10370 - DNA, 59 bp, Homo sapiens
  chr10:83636287-83636346
  hyper
gagagagggccttcccgaaggcactgagccccttctccgcccgccggtaggaaggaaag

SEQ ID NO: 10371 - DNA, 30 bp, Homo sapiens
  chr10:85954715-85954745
  hyper
tcttcctggcccattcggtagtggggagtg

SEQ ID NO: 10372 - DNA, 516 bp, Homo sapiens
  chr10:88125592-88126108
  hyper
gccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcac

SEQ ID NO: 10373 - DNA, 20 bp, Homo sapiens
  chr10:88126833-88126853
  hyper
agaatggaggagggccggcc

SEQ ID NO: 10374 - DNA, 279 bp, Homo sapiens
  chr10:88126854-88127133
  hyper
ctaactgccctcgaggggctcccgaagcgccctggcgacctcagcagccgcgcgtctcgggtcatgtccccggccgaaacagaccgttcctcgtggagtgggacctggggagcaagaagagagaccggggcggggcgccgggccaggccccaggacagctggggagccagagggggccggccgccgcaagcatctcagagtagagcccgggccgtgggctcgaaccctggctggccgcgcggacctcggcgggcgcccatcccccgctccatgggcagc

SEQ ID NO: 10375 - DNA, 14 bp, Homo sapiens
  chr10:88127346-88127360
  hyper
ggtgcctgcctcgg

SEQ ID NO: 10376 - DNA, 87 bp, Homo sapiens
  chr10:88149420-88149507
  hyper
gctcccaggtctgggcgttaggattctctcagtcccggagccacgccggctgaccgcagggctcggggagcgcggctgggccccttt

SEQ ID NO: 10377 - DNA, 132 bp, Homo sapiens
  chr10:88391908-88392040
  hyper
gaggatacagggagccgtttgcctgggttcgcgctcggctgtcctagctcacggggcgacctcggaaacgtccagcgtctgccctgtccccctgcgccgcgtctgagcagccagccccgggccaaagggtcg

SEQ ID NO: 10378 - DNA, 42 bp, Homo sapiens
  chr10:90343138-90343180
  hyper
cgtccttgaggagcaaacctggggctgcggagaaccggggct

SEQ ID NO: 10379 - DNA, 30 bp, Homo sapiens
  chr10:90966573-90966603
  hyper
accttgtggaaggtgcggtacagccagggc

SEQ ID NO: 10380 - DNA, 153 bp, Homo sapiens
  chr10:90967173-90967326
  hyper
aataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 10381 - DNA, 512 bp, Homo sapiens; identical to SEQ ID NO: 3577
  chr10:90967644-90968156
  hyper

SEQ ID NO: 10382 - DNA, 87 bp, Homo sapiens
  chr10:91295259-91295346
  hyper
gcttcttggccagggcgctggggatccgggagcgggggccgccggcgagactgagcccgggacagcccagagctccagcgctccagc

SEQ ID NO: 10383 - DNA, 145 bp, Homo sapiens
  chr10:91295347-91295492
  hyper
ctctgcagcccgcccagagcgcgcagaccacccccatgccccgcccgccctcctgccacacccgcccccagcccggccccgccgcctcctcacctcgccgggaccactgcagccctggcggtagcgcgcggacatgcccccgggg

SEQ ID NO: 10384 - DNA, 295 bp, Homo sapiens
  chr10:91295584-91295879
  hyper
cggaggcgccggcgaggctggggccgggggcctagctggcaacgccgggagagggaagcgtagcgcggaaaatcccagtgctcggccttcgaaatgcaccggctcattcagccccgccagctccgccggggactctgcctggccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccc

SEQ ID NO: 10385 - DNA, 139 bp, Homo sapiens; identical to SEQ ID NO: 3578
  chr10:92617227-92617366
  hyper

SEQ ID NO: 10386 - DNA, 529 bp, Homo sapiens
  chr10:93647119-93647648
  hyper
ggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaacc

SEQ ID NO: 10387 - DNA, 2 bp, Homo sapiens
  chr10:93647649-93647651
  hyper
aa

SEQ ID NO: 10388 - DNA, 70 bp, Homo sapiens
  chr10:94180377-94180447
  hyper
acagccgttgggtaacggatcaaaacccttaacggccgcggctggagcgcgagctcggggcgccgagggg

SEQ ID NO: 10389 - DNA, 30 bp, Homo sapiens
  chr10:94451474-94451504
  hyper
aagcaaagagtttttcgagctagaccaaca

SEQ ID NO: 10390 - DNA, 30 bp, Homo sapiens
  chr10:94822377-94822407
  hyper
agagggagaaaggaccggaactggccttct

SEQ ID NO: 10391 - DNA, 328 bp, Homo sapiens
  chr10:94828193-94828521
  hyper
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgcc

SEQ ID NO: 10392 - DNA, 159 bp, Homo sapiens; identical to SEQ ID NO: 898
  chr10:94828735-94828894
  hyper

SEQ ID NO: 10393 - DNA, 53 bp, Homo sapiens
  chr10:94831830-94831883
  hyper
ggccagaggttggttcgccgtgtttacagccaccaaatcgtttgccggagact

SEQ ID NO: 10394 - DNA, 92 bp, Homo sapiens
  chr10:94833030-94833122
  hyper
tctgcctattgcgcccgatgccccgaggctctctcttggactctggccctgagttcttctgcgcgatccttcggagacgtctggaggcctgc

SEQ ID NO: 10395 - DNA, 937 bp, Homo sapiens; identical to SEQ ID NO: 899
  chr10:94834033-94834970
  hyper

SEQ ID NO: 10396 - DNA, 36 bp, Homo sapiens
  chr10:95361207-95361243
  hyper
cggccaggccaaatgcgccagcggccctggctcagt

SEQ ID NO: 10397 - DNA, 243 bp, Homo sapiens
  chr10:98945514-98945757
  hyper
ccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgcgcacgcaccctgcgcaca

SEQ ID NO: 10398 - DNA, 29 bp, Homo sapiens
  chr10:98945992-98946021
  hyper
gggtgtgactcgacccgccaagtcctggc

SEQ ID NO: 10399 - DNA, 76 bp, Homo sapiens
  chr10:98946094-98946170
  hyper
cgcaccccggcacccgcggccccagctgctagtccagggtgggagggagatcttattttgccgcttggacgccttc

SEQ ID NO: 10400 - DNA, 185 bp, Homo sapiens; identical to SEQ ID NO: 3581
  chr10:99080262-99080447
  hyper

SEQ ID NO: 10401 - DNA, 127 bp, Homo sapiens
  chr10:99531148-99531275
  hyper
caggccaggggaagccgtaggcctccatgagcggcgcgcagccggcgcgcacggcctcgcacagcgagcggcacgggtagatgggccggtcgagacagacgggcgcaaagagcgagcacaggaagac

SEQ ID NO: 10402 - DNA, 98 bp, Homo sapiens
  chr10:99531512-99531610
  hyper
cggcgcccagtgcagcgcccccagcagcagcgccagcgcggccgtccgcacgcccccccccgccgccgccgcccgcatggctgcgccctctccaggtg

SEQ ID NO: 10403 - DNA, 16 bp, Homo sapiens
  chr10:99531863-99531879
  hyper
gccctcagcccctccc

SEQ ID NO: 10404 - DNA, 101 bp, Homo sapiens
  chr10:99531880-99531981
  hyper
caccctgcccgagcgtcccgcccagcgccaggtcttgcgcccctctcccggctcggctcccctgccgcagccctggcctcgcccagcgtttctccccaggg

SEQ ID NO: 10405 - DNA, 119 bp, Homo sapiens; identical to SEQ ID NO: 900
  chr10:99789175-99789294
  hyper

SEQ ID NO: 10406 - DNA, 44 bp, Homo sapiens
  chr10:99789739-99789783
  hyper
tccccagcctggaagcgtaggcactcggccgaggccagtggctt

SEQ ID NO: 10407 - DNA, 32 bp, Homo sapiens; identical to SEQ ID NO: 901
  chr10:99790308-99790340
  hyper

SEQ ID NO: 10408 - DNA, 323 bp, Homo sapiens; identical to SEQ ID NO: 902
  chr10:99790437-99790760
  hyper

SEQ ID NO: 10409 - DNA, 260 bp, Homo sapiens; identical to SEQ ID NO: 903
  chr10:99790917-99791177
  hyper

SEQ ID NO: 10410 - DNA, 74 bp, Homo sapiens; identical to SEQ ID NO: 904
  chr10:100992117-100992191
  hyper

SEQ ID NO: 10411 - DNA, 5 bp, Homo sapiens
  chr10:100992221-100992226
  hyper
cgggc

SEQ ID NO: 10412 - DNA, 49 bp, Homo sapiens
  chr10:100992458-100992507
  hyper
gggggctgtgcctcccgcttccagacgcccgcagcggccccctcccgca

SEQ ID NO: 10413 - DNA, 451 bp, Homo sapiens; identical to SEQ ID NO: 906
  chr10:100993487-100993938
  hyper

SEQ ID NO: 10414 - DNA, 456 bp, Homo sapiens; identical to SEQ ID NO: 907
  chr10:100993939-100994395
  hyper

SEQ ID NO: 10415 - DNA, 62 bp, Homo sapiens
  chr10:100994599-100994661
  hyper
aggaggaggaactggcggggggaggggggcattccgtctataaaaagcgccttacaaagtcc

SEQ ID NO: 10416 - DNA, 427 bp, Homo sapiens; identical to SEQ ID NO: 908
  chr10:100995797-100996224
  hyper

SEQ ID NO: 10417 - DNA, 171 bp, Homo sapiens
  chr10:101088995-101089166
  hyper
agtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcgg

SEQ ID NO: 10418 - DNA, 43 bp, Homo sapiens
  chr10:101089367-101089410
  hyper
atttccagccaggaccgccggccaccgccgcaccggtgccctc

SEQ ID NO: 10419 - DNA, 55 bp, Homo sapiens
  chr10:101089855-101089910
  hyper
ctgttcagcggcctgcgcctgagcctgctgtcgctggacccggtggagttacggg

SEQ ID NO: 10420 - DNA, 258 bp, Homo sapiens
  chr10:101280193-101280451
  hyper
cacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccaga

SEQ ID NO: 10421 - DNA, 253 bp, Homo sapiens
  chr10:101283181-101283434
  hyper
atactgaatagaaagcgaaggacggaggtagggagaaaggaaactgctctggggggcggaggtgggggtacacgtaggagggaaggggagggggctagaggaggctccgccccaccgtccggcagtgtttattttcaaggcagcttcccgtcaatcctgtcaccggggcacattcttttcgggggctgtgaaccaccgtcagggctctgcaggaagatttgaggagggggagggctgtcgagtagggagcagg

SEQ ID NO: 10422 - DNA, 327 bp, Homo sapiens; identical to SEQ ID NO: 909
  chr10:101290372-101290699
  hyper

SEQ ID NO: 10423 - DNA, 443 bp, Homo sapiens; identical to SEQ ID NO: 910
  chr10:101290700-101291143
  hyper

SEQ ID NO: 10424 - DNA, 403 bp, Homo sapiens; identical to SEQ ID NO: 911
  chr10:101292461-101292864
  hyper

SEQ ID NO: 10425 - DNA, 290 bp, Homo sapiens; identical to SEQ ID NO: 3594
  chr10:101293164-101293454
  hyper

SEQ ID NO: 10426 - DNA, 644 bp, Homo sapiens; identical to SEQ ID NO: 3595
  chr10:101294756-101295400
  hyper

SEQ ID NO: 10427 - DNA, 152 bp, Homo sapiens; identical to SEQ ID NO: 3596
  chr10:101295401-101295553
  hyper

SEQ ID NO: 10428 - DNA, 44 bp, Homo sapiens
  chr10:101875049-101875093
  hyper
tgcctgcaccggggccgccccgcaccccccgccaacccccagcc

SEQ ID NO: 10429 - DNA, 49 bp, Homo sapiens
  chr10:102322230-102322279
  hyper
cccccgaccttccgccgactggccgtgggctggccgcagcccagctcgg

SEQ ID NO: 10430 - DNA, 30 bp, Homo sapiens
  chr10:102414410-102414440
  hyper
tgcataagattaagccgaggctctcagctg

SEQ ID NO: 10431 - DNA, 448 bp, Homo sapiens
  chr10:102419399-102419847
  hyper
cgtatcatccggcatatttgctgcttggctagccaaatagaagttgttttttgcacaaatttccttgtcaaatttgtcaatgttcatgtcatttttgctttaggtcacagagcaaggtgcaaattcctggcatctttactagttgcagccaatttcggcgatttcggcggtgacggggattctcagaggagccgcgtgcccgtgcgctcccgcctgtcggccccagagagcgcagccctgacacctcctcccggaagcccgccggcccgaccctggtttggaaggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 10432 - DNA, 116 bp, Homo sapiens
  chr10:102430682-102430798
  hyper
tactcctgacaggatcgccgggggcacggctgcgagataaccattagcgcagccgccgataaagcggggaggctgcatttccaaaggctccgcggccattacgggaaagttagtgt

SEQ ID NO: 10433 - DNA, 39 bp, Homo sapiens
  chr10:102470136-102470175
  hyper
ccagccggcctggggcgccctagccgctggtcctggccc

SEQ ID NO: 10434 - DNA, 30 bp, Homo sapiens
  chr10:102470378-102470408
  hyper
gtagaggggcttccccgggtgtgaggtgac

SEQ ID NO: 10435 - DNA, 197 bp, Homo sapiens
  chr10:102473519-102473716
  hyper
cccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 10436 - DNA, 250 bp, Homo sapiens
  chr10:102473759-102474009
  hyper
cggaggtgggactggggagcagggcctgggactccgctggtgggggtacacgcaggggcactggcgggggcggggggcgacggcactcagaattgcgctgaggcaaattccccgccaggtccagattggggggcgcgaggacaggagcatcgagtgcccggatagctgagcccccccactccccatccccttcctggaccccacgtctagggccgctggcggctcctgcgattagcgctccagatgtttg

SEQ ID NO: 10437 - DNA, 50 bp, Homo sapiens
  chr10:102475641-102475691
  hyper
caggggccgaggctccgccattggggttaacggtgcggaagaatacaaaa

SEQ ID NO: 10438 - DNA, 41 bp, Homo sapiens
  chr10:102475904-102475945
  hyper
tggtcacacctcttccgcgggaggggcggggtcggcggcca

SEQ ID NO: 10439 - DNA, 30 bp, Homo sapiens
  chr10:102483765-102483795
  hyper
cgaggggagggggctcgatgggggaattgc

SEQ ID NO: 10440 - DNA, 111 bp, Homo sapiens; identical to SEQ ID NO: 3597
  chr10:102484269-102484380
  hyper

SEQ ID NO: 10441 - DNA, 60 bp, Homo sapiens
  chr10:102489604-102489664
  hyper
ctccccacctcccttcgcgccagggctgaaagtcccaggcgcccaatgcgtgcccaagaa

SEQ ID NO: 10442 - DNA, 15 bp, Homo sapiens
  chr10:102489700-102489715
  hyper
cgccatggacccagg

SEQ ID NO: 10443 - DNA, 16 bp, Homo sapiens
  chr10:102495125-102495141
  hyper
ggctgggctgcggtcc

SEQ ID NO: 10444 - DNA, 51 bp, Homo sapiens
  chr10:102495142-102495193
  hyper
tgggcgcctcaggcagcgagggtggctgcttgcctgcggctggctggggcc

SEQ ID NO: 10445 - DNA, 35 bp, Homo sapiens
  chr10:102495544-102495579
  hyper
gggggcggccatggccggggcgggctcctctcctc

SEQ ID NO: 10446 - DNA, 15 bp, Homo sapiens
  chr10:102497161-102497176
  hyper
gggcggccgcttacc

SEQ ID NO: 10447 - DNA, 46 bp, Homo sapiens; identical to SEQ ID NO: 3599
  chr10:102497252-102497298
  hyper

SEQ ID NO: 10448 - DNA, 26 bp, Homo sapiens
  chr10:102497299-102497325
  hyper
ggggggagctgcggagctgggcagga

SEQ ID NO: 10449 - DNA, 241 bp, Homo sapiens; identical to SEQ ID NO: 912
  chr10:102497525-102497766
  hyper

SEQ ID NO: 10450 - DNA, 32 bp, Homo sapiens
  chr10:102498739-102498771
  hyper
gagggcctaatccgtcgcgcgcgcgcacgcgg

SEQ ID NO: 10451 - DNA, 211 bp, Homo sapiens
  chr10:102498831-102499042
  hyper
cagcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctc

SEQ ID NO: 10452 - DNA, 128 bp, Homo sapiens; identical to SEQ ID NO: 3602
  chr10:102501247-102501375
  hyper

SEQ ID NO: 10453 - DNA, 181 bp, Homo sapiens
  chr10:102501875-102502056
  hyper
gcttctgccttttctcgcctgggcagaaaacgctgggccagggaactggaaaccggaaaacaggagaaagggtttctggaaggcagcgggagcgggtggcagcggggcagcgggcagtggactaggtctacaccggcacttcacttttgcacaacatgcccagaaacgcatttgagagccc

SEQ ID NO: 10454 - DNA, 30 bp, Homo sapiens
  chr10:102502378-102502408
  hyper
ttgcctttaaatttccgcagggaggcgggc

SEQ ID NO: 10455 - DNA, 216 bp, Homo sapiens
  chr10:102504302-102504518
  hyper
tgcgcctcctgcgctcgccccggatccaccgagctagcagcgggcggcgctcagccgcgtccgcagcctcctcttctccccagccggggagagccagcctcgtctcccacatcctctgccgccagcgacctgcagctccgcactgtttccctcccctgtacccccttcccagtcacccgagggttcagaaaccaagtcccccggctctcccgccat

SEQ ID NO: 10456 - DNA, 69 bp, Homo sapiens; identical to SEQ ID NO: 913
  chr10:102507467-102507536
  hyper

SEQ ID NO: 10457 - DNA, 43 bp, Homo sapiens
  chr10:102507908-102507951
  hyper
ctggggctgaggggccgggccctgagcccggggaggctgaatt

SEQ ID NO: 10458 - DNA, 470 bp, Homo sapiens
  chr10:102508341-102508811
  hyper
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctct

SEQ ID NO: 10459 - DNA, 145 bp, Homo sapiens
  chr10:102509140-102509285
  hyper
ggcccttcctctcctcgctttcttacgccctttccgctggcatgaattcccctttggcattttctcccctctcccctcttttctgtcatctggtttctctccagtcccccctttgctttctaccttgcgtcgcaaggcctgagtc

SEQ ID NO: 10460 - DNA, 48 bp, Homo sapiens
  chr10:102509494-102509542
  hyper
ctccccagcagggcacgggggtgtgaaccagctcgggggggtgtttgt

SEQ ID NO: 10461 - DNA, 1165 bp, Homo sapiens; identical to SEQ ID NO: 914
  chr10:102589250-102590415
  hyper

SEQ ID NO: 10462 - DNA, 51 bp, Homo sapiens; identical to SEQ ID NO: 3605
  chr10:102890968-102891019
  hyper

SEQ ID NO: 10463 - DNA, 274 bp, Homo sapiens; identical to SEQ ID NO: 3606
  chr10:102891020-102891294
  hyper

SEQ ID NO: 10464 - DNA, 380 bp, Homo sapiens; identical to SEQ ID NO: 3607
  chr10:102891576-102891956
  hyper

SEQ ID NO: 10465 - DNA, 369 bp, Homo sapiens; identical to SEQ ID NO: 915
  chr10:102893583-102893952
  hyper

SEQ ID NO: 10466 - DNA, 1155 bp, Homo sapiens; identical to SEQ ID NO: 916
  chr10:102894090-102895245
  hyper

SEQ ID NO: 10467 - DNA, 683 bp, Homo sapiens; identical to SEQ ID NO: 917
  chr10:102899173-102899856
  hyper

SEQ ID NO: 10468 - DNA, 372 bp, Homo sapiens; identical to SEQ ID NO: 918
  chr10:102900262-102900634
  hyper

SEQ ID NO: 10469 - DNA, 40 bp, Homo sapiens
  chr10:102905699-102905739
  hyper
ccacaaggacttgtccgggccgggccgggctagatgccga

SEQ ID NO: 10470 - DNA, 125 bp, Homo sapiens
  chr10:102975199-102975324
  hyper
tctgcccccaagtttcgaggaactgccccccagcgcccaggaggaaaggggaatggggctgtaaacgtgtctaattcagacccgttatccagatcggaattagtttctcgcggacacctccgcgc

SEQ ID NO: 10471 - DNA, 88 bp, Homo sapiens
  chr10:102975771-102975859
  hyper
agagactgaaggaggcggggcatgggaccccggaagatgcctcccagacgttccaggcctgcttgcccggctccggaggtcttagcag

SEQ ID NO: 10472 - DNA, 70 bp, Homo sapiens
  chr10:102976414-102976484
  hyper
gcaggatggattagccgagcaacgacctagagtctgagaaacgggcaggcacaaacgcttactcagacca

SEQ ID NO: 10473 - DNA, 712 bp, Homo sapiens
  chr10:102977236-102977948
  hyper
gctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattg

SEQ ID NO: 10474 - DNA, 280 bp, Homo sapiens
  chr10:102978742-102979022
  hyper
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttg

SEQ ID NO: 10475 - DNA, 224 bp, Homo sapiens
  chr10:102982567-102982791
  hyper
gccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccaga

SEQ ID NO: 10476 - DNA, 30 bp, Homo sapiens
  chr10:102983002-102983032
  hyper
gagcctacacttgggcgaacacaccactgc

SEQ ID NO: 10477 - DNA, 135 bp, Homo sapiens; identical to SEQ ID NO: 919
  chr10:102983245-102983380
  hyper

SEQ ID NO: 10478 - DNA, 315 bp, Homo sapiens; identical to SEQ ID NO: 920
  chr10:102983434-102983749
  hyper

SEQ ID NO: 10479 - DNA, 4 bp, Homo sapiens
  chr10:102984512-102984516
  hyper
cgag

SEQ ID NO: 10480 - DNA, 1497 bp, Homo sapiens; identical to SEQ ID NO: 3614
  chr10:102985456-102986953
  hyper

SEQ ID NO: 10481 - DNA, 136 bp, Homo sapiens; identical to SEQ ID NO: 3615
  chr10:102987206-102987342
  hyper

SEQ ID NO: 10482 - DNA, 256 bp, Homo sapiens
  chr10:102989238-102989494
  hyper
aagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtct

SEQ ID NO: 10483 - DNA, 329 bp, Homo sapiens
  chr10:102989968-102990297
  hyper
ggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 10484 - DNA, 455 bp, Homo sapiens; identical to SEQ ID NO: 921
  chr10:102996026-102996481
  hyper

SEQ ID NO: 10485 - DNA, 123 bp, Homo sapiens; identical to SEQ ID NO: 922
  chr10:102996596-102996719
  hyper

SEQ ID NO: 10486 - DNA, 142 bp, Homo sapiens; identical to SEQ ID NO: 3618
  chr10:102997086-102997228
  hyper

SEQ ID NO: 10487 - DNA, 303 bp, Homo sapiens; identical to SEQ ID NO: 3619
  chr10:102997281-102997584
  hyper

SEQ ID NO: 10488 - DNA, 503 bp, Homo sapiens; identical to SEQ ID NO: 923
  chr10:102998356-102998859
  hyper

SEQ ID NO: 10489 - DNA, 304 bp, Homo sapiens; identical to SEQ ID NO: 924
  chr10:103043924-103044228
  hyper

SEQ ID NO: 10490 - DNA, 99 bp, Homo sapiens; identical to SEQ ID NO: 925
  chr10:103044300-103044399
  hyper

SEQ ID NO: 10491 - DNA, 36 bp, Homo sapiens
  chr10:103051231-103051267
  hyper
gcctccatgccgcgtcggccgcggccttgggggtct

SEQ ID NO: 10492 - DNA, 553 bp, Homo sapiens
  chr10:103534896-103535449
  hyper
acaccctggggctcccggccagcccggaacagggaagcgagctccctgcccagcgcagggcccctgcccgggccttcctagaggagcagggcgcttttaagtagggaggcagccctccccgacccctgacatttataaagacaaatttacggagcaaatgttgagagtgcagggaacctgggcacccgatcattgggccaaatcggccacaagcctcccccgaggggcgctgagagggtctctgctgcagtcacccggcttcccctggcatcgaacatccatcccctggccgcggctgcccccttcctcggcggctgggtgttccctatgcccccagccggcgaggatgcatgggggacagtgctgggctccgagaccttcgtttctatcctggccactcactcgctgtgtgacctcaggaggggtgctacctctctgtgcctcagctccctcctcggggtggctcggggctgggtttctaaggtgccctcagccctcccgcgccggccgcagagtcagtcccggtgcccccgaccggcgctgcccacccggg

SEQ ID NO: 10493 - DNA, 6 bp, Homo sapiens
  chr10:103535765-103535771
  hyper
ggccgg

SEQ ID NO: 10494 - DNA, 177 bp, Homo sapiens; identical to SEQ ID NO: 3623
  chr10:103536320-103536497
  hyper

SEQ ID NO: 10495 - DNA, 108 bp, Homo sapiens
  chr10:103986112-103986220
  hyper
cgcagtggctgcgcccgggatagctggctgcgccgccgcgcacatgcctaggttcgacgccctcctccctttgcccaggagttccttctgtcccggctctgttccgtc

SEQ ID NO: 10496 - DNA, 142 bp, Homo sapiens
  chr10:104000843-104000985
  hyper
ctggtttcaagtctccggcttcgttccggatcctctgagtctcccccttccctatcccctggttcttaccctgagtttcccttttcccaagtcctggccccaggtctgcagtccgccctcccattctcgacctgttcccaag

SEQ ID NO: 10497 - DNA, 62 bp, Homo sapiens; identical to SEQ ID NO: 3624
  chr10:104170201-104170263
  hyper

SEQ ID NO: 10498 - DNA, 106 bp, Homo sapiens; identical to SEQ ID NO: 3625
  chr10:104170407-104170513
  hyper

SEQ ID NO: 10499 - DNA, 287 bp, Homo sapiens; identical to SEQ ID NO: 3626
  chr10:104170514-104170801
  hyper

SEQ ID NO: 10500 - DNA, 209 bp, Homo sapiens; identical to SEQ ID NO: 3627
  chr10:105036450-105036659
  hyper

SEQ ID NO: 10501 - DNA, 163 bp, Homo sapiens; identical to SEQ ID NO: 3628
  chr10:105036700-105036863
  hyper

SEQ ID NO: 10502 - DNA, 19 bp, Homo sapiens
  chr10:105036864-105036883
  hyper
ccttaaaagccgggcgcac

SEQ ID NO: 10503 - DNA, 717 bp, Homo sapiens; identical to SEQ ID NO: 3630
  chr10:105036893-105037610
  hyper

SEQ ID NO: 10504 - DNA, 86 bp, Homo sapiens
  chr10:105041683-105041769
  hyper
tccctcaggctaagccggcagcagctgcgtggttgggggaggggacagactgcagcgctctgctcagatctcgagctggaggccat

SEQ ID NO: 10505 - DNA, 5 bp, Homo sapiens
  chr10:106398825-106398830
  hyper
cgcgc

SEQ ID NO: 10506 - DNA, 934 bp, Homo sapiens; identical to SEQ ID NO: 3631
  chr10:106399442-106400376
  hyper

SEQ ID NO: 10507 - DNA, 110 bp, Homo sapiens; identical to SEQ ID NO: 3632
  chr10:106400808-106400918
  hyper

SEQ ID NO: 10508 - DNA, 111 bp, Homo sapiens; identical to SEQ ID NO: 3633
  chr10:106401322-106401433
  hyper

SEQ ID NO: 10509 - DNA, 681 bp, Homo sapiens; identical to SEQ ID NO: 3634
  chr10:106401510-106402191
  hyper

SEQ ID NO: 10510 - DNA, 80 bp, Homo sapiens; identical to SEQ ID NO: 3635
  chr10:106402271-106402351
  hyper

SEQ ID NO: 10511 - DNA, 205 bp, Homo sapiens; identical to SEQ ID NO: 3636
  chr10:106402620-106402825
  hyper

SEQ ID NO: 10512 - DNA, 30 bp, Homo sapiens
  chr10:108923969-108923999
  hyper
ggagcgtgcagcaaccgccatggatgcccc

SEQ ID NO: 10513 - DNA, 19 bp, Homo sapiens
  chr10:108924382-108924401
  hyper
actccatccaagttgcgcc

SEQ ID NO: 10514 - DNA, 1 bp, Homo sapiens
  chr10:109674853-109674854
  hyper
c

SEQ ID NO: 10515 - DNA, 68 bp, Homo sapiens
  chr10:109674855-109674923
  hyper
gcagccgccagcagagcccggtgcgggaccgggagctgccggggcctcagctccgctctccccacagc

SEQ ID NO: 10516 - DNA, 257 bp, Homo sapiens
  chr10:110225912-110226169
  hyper
tctcctgcacctggtcgcggtggcgcgcccccatctcccgctgaaacccagaactttcggttcagcagggctgggaagcagccgccggcgcccacttttcccaccgcgggggcggagaacagcagagaggggtcccagaccgaaggtggcagcgcgtggctctgcgctggcggctgtggggggcaggcgctcaggaccccaattccctccaagttgggccgcggtgggggcgggtggaggtggcgccgggcagctgg

SEQ ID NO: 10517 - DNA, 71 bp, Homo sapiens
  chr10:110671709-110671780
  hyper
gctctcaatagagggcgcgctgggcgaagtaggggcgtggcaggagccccgctccgcggatccaggttgaa

SEQ ID NO: 10518 - DNA, 180 bp, Homo sapiens; identical to SEQ ID NO: 3637
  chr10:110672065-110672245
  hyper

SEQ ID NO: 10519 - DNA, 51 bp, Homo sapiens; identical to SEQ ID NO: 3638
  chr10:111216345-111216396
  hyper

SEQ ID NO: 10520 - DNA, 15 bp, Homo sapiens
  chr10:111216789-111216804
  hyper
caactccagccaagt

SEQ ID NO: 10521 - DNA, 705 bp, Homo sapiens
  chr10:112403151-112403856
  hyper
tcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtg

SEQ ID NO: 10522 - DNA, 56 bp, Homo sapiens
  chr10:112404226-112404282
  hyper
agccatgagccaggacgcggaccccagcggtccggagcagccggacagagttgcct

SEQ ID NO: 10523 - DNA, 76 bp, Homo sapiens
  chr10:112431872-112431948
  hyper
ggcattgcttttacccggtgggcttcagggagccgtccctgccgcgctttgcgtttctccgcgcacttggacaggg

SEQ ID NO: 10524 - DNA, 70 bp, Homo sapiens
  chr10:115804051-115804121
  hyper
ctcagcagtggacagcgggcatgggtctgctgatggcgctcatcgtgctgctcatcgtggcgggcaatgt

SEQ ID NO: 10525 - DNA, 79 bp, Homo sapiens; identical to SEQ ID NO: 926
  chr10:115804976-115805055
  hyper

SEQ ID NO: 10526 - DNA, 154 bp, Homo sapiens
  chr10:116852264-116852418
  hyper
gcggtttcgaggcagcgtctgtaaggggtggagagcgcggggctcggagcctcgcagttctttgttgggggcgcgggcttcgttattcccgaggcagcaatggctccccctcggaggtccctccgcggagaccgcctcgcgcctctcgcagtcc

SEQ ID NO: 10527 - DNA, 48 bp, Homo sapiens
  chr10:118030658-118030706
  hyper
ggcgggcggggaccccggccgcccctgctccgggcgagggcgcgcgcc

SEQ ID NO: 10528 - DNA, 74 bp, Homo sapiens
  chr10:118031388-118031462
  hyper
cacatccaccacacccgcgccccaattttggtgcggagggcggggtgggctgctgcaagcgaccctaggaaaga

SEQ ID NO: 10529 - DNA, 16 bp, Homo sapiens
  chr10:118031848-118031864
  hyper
ccctctcccctccccc

SEQ ID NO: 10530 - DNA, 263 bp, Homo sapiens
  chr10:118031865-118032128
  hyper
ttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggc

SEQ ID NO: 10531 - DNA, 397 bp, Homo sapiens; identical to SEQ ID NO: 3640
  chr10:118032412-118032809
  hyper

SEQ ID NO: 10532 - DNA, 95 bp, Homo sapiens; identical to SEQ ID NO: 927
  chr10:118033068-118033163
  hyper

SEQ ID NO: 10533 - DNA, 454 bp, Homo sapiens; identical to SEQ ID NO: 928
  chr10:118033223-118033677
  hyper

SEQ ID NO: 10534 - DNA, 157 bp, Homo sapiens; identical to SEQ ID NO: 3643
  chr10:118890938-118891095
  hyper

SEQ ID NO: 10535 - DNA, 145 bp, Homo sapiens; identical to SEQ ID NO: 929
  chr10:118891517-118891662
  hyper

SEQ ID NO: 10536 - DNA, 59 bp, Homo sapiens; identical to SEQ ID NO: 930
  chr10:118891715-118891774
  hyper

SEQ ID NO: 10537 - DNA, 444 bp, Homo sapiens; identical to SEQ ID NO: 931
  chr10:118892013-118892457
  hyper

SEQ ID NO: 10538 - DNA, 44 bp, Homo sapiens; identical to SEQ ID NO: 932
  chr10:118892517-118892561
  hyper

SEQ ID NO: 10539 - DNA, 283 bp, Homo sapiens; identical to SEQ ID NO: 933
  chr10:118892955-118893238
  hyper

SEQ ID NO: 10540 - DNA, 72 bp, Homo sapiens; identical to SEQ ID NO: 934
  chr10:118893679-118893751
  hyper

SEQ ID NO: 10541 - DNA, 14 bp, Homo sapiens
  chr10:118894477-118894491
  hyper
ggaatttccggtgg

SEQ ID NO: 10542 - DNA, 229 bp, Homo sapiens
  chr10:118896540-118896769
  hyper
cagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagca

SEQ ID NO: 10543 - DNA, 30 bp, Homo sapiens
  chr10:118897545-118897575
  hyper
ttttgtctggtttcccgaacataggcaaga

SEQ ID NO: 10544 - DNA, 260 bp, Homo sapiens
  chr10:118897895-118898155
  hyper
tcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 10545 - DNA, 353 bp, Homo sapiens; identical to SEQ ID NO: 935
  chr10:118899892-118900245
  hyper

SEQ ID NO: 10546 - DNA, 113 bp, Homo sapiens; identical to SEQ ID NO: 936
  chr10:118900323-118900436
  hyper

SEQ ID NO: 10547 - DNA, 360 bp, Homo sapiens
  chr10:118922201-118922561
  hyper
tttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtc

SEQ ID NO: 10548 - DNA, 30 bp, Homo sapiens
  chr10:118922778-118922808
  hyper
ctccccgagcactgccggccaggccgggct

SEQ ID NO: 10549 - DNA, 242 bp, Homo sapiens
  chr10:118923063-118923305
  hyper
gcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatcccct

SEQ ID NO: 10550 - DNA, 292 bp, Homo sapiens; identical to SEQ ID NO: 3653
  chr10:118924431-118924723
  hyper

SEQ ID NO: 10551 - DNA, 480 bp, Homo sapiens
  chr10:118925062-118925542
  hyper
ttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagatttttt

SEQ ID NO: 10552 - DNA, 86 bp, Homo sapiens
  chr10:118925816-118925902
  hyper
gcgttcagagagacacgtttggagctgggactgttcattctttaaggaacaccagcttccagggcatctttcgttggcaccttggc

SEQ ID NO: 10553 - DNA, 537 bp, Homo sapiens; identical to SEQ ID NO: 937
  chr10:118927026-118927563
  hyper

SEQ ID NO: 10554 - DNA, 30 bp, Homo sapiens
  chr10:118928412-118928442
  hyper
aaccccgctggcagacgggatggagagaga

SEQ ID NO: 10555 - DNA, 113 bp, Homo sapiens
  chr10:119000479-119000592
  hyper
gcggggacagggaggcggcagcccctcctgcgcagcgacggcgcgggcgggcggaggccggggcgccccagccccccgcccccgctccctccggccgtgacgtcagagccgga

SEQ ID NO: 10556 - DNA, 21 bp, Homo sapiens
  chr10:119000689-119000710
  hyper
cgggcacggaggacccgggca

SEQ ID NO: 10557 - DNA, 244 bp, Homo sapiens; identical to SEQ ID NO: 3655
  chr10:119000911-119001155
  hyper

SEQ ID NO: 10558 - DNA, 200 bp, Homo sapiens; identical to SEQ ID NO: 3656
  chr10:119001328-119001528
  hyper

SEQ ID NO: 10559 - DNA, 85 bp, Homo sapiens
  chr10:119295037-119295122
  hyper
tcggctcactggcagcggcgaggccaccgaccaccctccgccttccagtcctaaactcggggctggagaccgcaggagctaaacc

SEQ ID NO: 10560 - DNA, 19 bp, Homo sapiens
  chr10:119296755-119296774
  hyper
cgggcgtcttcagccagcc

SEQ ID NO: 10561 - DNA, 83 bp, Homo sapiens
  chr10:119297144-119297227
  hyper
cactggcctggatgacggcctaggcgagactttggcagtgtggcgcgaccccagcgctcccccgccctcgggctcgggggcgc

SEQ ID NO: 10562 - DNA, 183 bp, Homo sapiens; identical to SEQ ID NO: 3657
  chr10:119297461-119297644
  hyper

SEQ ID NO: 10563 - DNA, 81 bp, Homo sapiens
  chr10:119300926-119301007
  hyper
tcataattatgccgccgcgcgagccaatggggacgagggaactcggtcctaaaatcatcccaaaaccgaaggcgagctcga

SEQ ID NO: 10564 - DNA, 105 bp, Homo sapiens; identical to SEQ ID NO: 3658
  chr10:119301323-119301428
  hyper

SEQ ID NO: 10565 - DNA, 99 bp, Homo sapiens
  chr10:119302909-119303008
  hyper
aaatccgttcctcaacggcttccactcggccgccgccgccgccgccggtaggggcgtctactccaacccggacttggtgttcgccgaggcggtctcgca

SEQ ID NO: 10566 - DNA, 409 bp, Homo sapiens
  chr10:119303312-119303721
  hyper
tgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatg

SEQ ID NO: 10567 - DNA, 37 bp, Homo sapiens
  chr10:119304504-119304541
  hyper
ttctcttctagttctcgggagccgggagccccggagc

SEQ ID NO: 10568 - DNA, 90 bp, Homo sapiens
  chr10:119304896-119304986
  hyper
ggactggctcctctgcgacagcggctggttgggtgccgcaccggtggagacccggcgttccgggccgggcagctgagcaggcgttccctt

SEQ ID NO: 10569 - DNA, 48 bp, Homo sapiens
  chr10:119305061-119305109
  hyper
gggccagcccggctcgggagaagtgcgcggctccggtcagagcagccc

SEQ ID NO: 10570 - DNA, 50 bp, Homo sapiens
  chr10:119312751-119312801
  hyper
tattccagcaatcagcgctggaattactggggcgccgcctagaagcaacc

SEQ ID NO: 10571 - DNA, 33 bp, Homo sapiens
  chr10:119494374-119494407
  hyper
taggaagcctagggtcgccgatgttccaggatg

SEQ ID NO: 10572 - DNA, 15 bp, Homo sapiens
  chr10:119494848-119494863
  hyper
cgggagaagttcagg

SEQ ID NO: 10573 - DNA, 30 bp, Homo sapiens
  chr10:120354243-120354273
  hyper
gatgcgccgcctcagcgggtgcaccagcac

SEQ ID NO: 10574 - DNA, 57 bp, Homo sapiens
  chr10:120355557-120355614
  hyper
gaggcacgactgacccgttcttaaaggctggatcctgcctagcggccaggttgcgga

SEQ ID NO: 10575 - DNA, 85 bp, Homo sapiens
  chr10:121301528-121301613
  hyper
gtaacgtcagaacttcgctggctcggaccgcagaagtgcccttctccatcctggggttccgccaccctcgcgatcccaccttttg

SEQ ID NO: 10576 - DNA, 112 bp, Homo sapiens
  chr10:122216112-122216224
  hyper
ctcctgagagcaaagcgaagcccgcgagtgatctctggggaacttcctagaaaaaagaaagaatttcaggttcgaacggtgtagggagggccgaacacgggagcaaggttgg

SEQ ID NO: 10577 - DNA, 232 bp, Homo sapiens
  chr10:122216525-122216757
  hyper
ctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 10578 - DNA, 42 bp, Homo sapiens
  chr10:122216793-122216835
  hyper
cgcgggagctgctccggccgcaccatgcgggagctggccatt

SEQ ID NO: 10579 - DNA, 34 bp, Homo sapiens
  chr10:122217317-122217351
  hyper
tgtccctggctttagcgcccgcggtcctggcgag

SEQ ID NO: 10580 - DNA, 176 bp, Homo sapiens; identical to SEQ ID NO: 938
  chr10:122708495-122708671
  hyper

SEQ ID NO: 10581 - DNA, 30 bp, Homo sapiens
  chr10:123356872-123356902
  hyper
gccccaggcgcactgcgctccctccagcgc

SEQ ID NO: 10582 - DNA, 38 bp, Homo sapiens; identical to SEQ ID NO: 939
  chr10:123922645-123922683
  hyper

SEQ ID NO: 10583 - DNA, 35 bp, Homo sapiens
  chr10:124221715-124221750
  hyper
caggttgaggggcagcgaagcgttgtggggtggcc

SEQ ID NO: 10584 - DNA, 78 bp, Homo sapiens
  chr10:124893272-124893350
  hyper
caggctgtgtgcaggcggtgcccacccaaccctcatagacctacgtgcatcgagctatttctgcggttgggggaaaat

SEQ ID NO: 10585 - DNA, 1013 bp, Homo sapiens; identical to SEQ ID NO: 3661
  chr10:124893594-124894607
  hyper

SEQ ID NO: 10586 - DNA, 52 bp, Homo sapiens; identical to SEQ ID NO: 3662
  chr10:124894870-124894922
  hyper

SEQ ID NO: 10587 - DNA, 535 bp, Homo sapiens; identical to SEQ ID NO: 940
  chr10:124895161-124895696
  hyper

SEQ ID NO: 10588 - DNA, 624 bp, Homo sapiens; identical to SEQ ID NO: 941
  chr10:124895832-124896456
  hyper

SEQ ID NO: 10589 - DNA, 437 bp, Homo sapiens; identical to SEQ ID NO: 3665
  chr10:124897220-124897657
  hyper

SEQ ID NO: 10590 - DNA, 16 bp, Homo sapiens
  chr10:124897957-124897973
  hyper
ccggcctagtttattc

SEQ ID NO: 10591 - DNA, 114 bp, Homo sapiens; identical to SEQ ID NO: 3667
  chr10:124899035-124899149
  hyper

SEQ ID NO: 10592 - DNA, 32 bp, Homo sapiens
  chr10:124899754-124899786
  hyper
cgctcaccacacccgcgcgctactgggttcca

SEQ ID NO: 10593 - DNA, 113 bp, Homo sapiens; identical to SEQ ID NO: 942
  chr10:124901934-124902047
  hyper

SEQ ID NO: 10594 - DNA, 431 bp, Homo sapiens; identical to SEQ ID NO: 943
  chr10:124902138-124902569
  hyper

SEQ ID NO: 10595 - DNA, 214 bp, Homo sapiens; identical to SEQ ID NO: 944
  chr10:124902607-124902821
  hyper

SEQ ID NO: 10596 - DNA, 267 bp, Homo sapiens; identical to SEQ ID NO: 945
  chr10:124903040-124903307
  hyper

SEQ ID NO: 10597 - DNA, 244 bp, Homo sapiens; identical to SEQ ID NO: 3672
  chr10:124904921-124905165
  hyper

SEQ ID NO: 10598 - DNA, 139 bp, Homo sapiens
  chr10:124905925-124906064
  hyper
ccggcacctgcccctcgctggcctcccgggccgctgcgcgcaccccctggcccccgccccctcgcctgcccctgccccggctgcgcggccgactcctaatcaattagcccattaacgagcccctcgaggagttaagtag

SEQ ID NO: 10599 - DNA, 296 bp, Homo sapiens; identical to SEQ ID NO: 3673
  chr10:124907293-124907589
  hyper

SEQ ID NO: 10600 - DNA, 316 bp, Homo sapiens; identical to SEQ ID NO: 3674
  chr10:124907979-124908295
  hyper

SEQ ID NO: 10601 - DNA, 125 bp, Homo sapiens
  chr10:124909252-124909377
  hyper
ggcgcggccaagaagaagacgcgcaccgtcttttcgcgcagccaggtgtaccagctcgagtccaccttcgacatgaagcgctacctgagcagctcggagcgcgcctgcctcgcctccagcctgca

SEQ ID NO: 10602 - DNA, 148 bp, Homo sapiens
  chr10:124910900-124911048
  hyper
gatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgca

SEQ ID NO: 10603 - DNA, 145 bp, Homo sapiens
  chr10:125425698-125425843
  hyper
tgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcg

SEQ ID NO: 10604 - DNA, 112 bp, Homo sapiens; identical to SEQ ID NO: 3675
  chr10:125651051-125651163
  hyper

SEQ ID NO: 10605 - DNA, 88 bp, Homo sapiens; identical to SEQ ID NO: 3676
  chr10:125651372-125651460
  hyper

SEQ ID NO: 10606 - DNA, 364 bp, Homo sapiens
  chr10:125851173-125851537
  hyper
tcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgc

SEQ ID NO: 10607 - DNA, 188 bp, Homo sapiens
  chr10:126135877-126136065
  hyper
cgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgg

SEQ ID NO: 10608 - DNA, 145 bp, Homo sapiens
  chr10:126136506-126136651
  hyper
gggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatc

SEQ ID NO: 10609 - DNA, 109 bp, Homo sapiens; identical to SEQ ID NO: 3677
  chr10:126137296-126137405
  hyper

SEQ ID NO: 10610 - DNA, 36 bp, Homo sapiens
  chr10:126137640-126137676
  hyper
ccttcatcaggtgtccgccagcgttgggagtaattc

SEQ ID NO: 10611 - DNA, 698 bp, Homo sapiens
  chr10:126138211-126138909
  hyper
gccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctc

SEQ ID NO: 10612 - DNA, 70 bp, Homo sapiens
  chr10:128075707-128075777
  hyper
agggaagtcgttcatcggtggaccgacagcgccccgggcggcagaaagaaggcggcggcggcggagaccc

SEQ ID NO: 10613 - DNA, 46 bp, Homo sapiens
  chr10:128075978-128076024
  hyper
aaggagggagaattccgctaaagtttgcctgcgactgacagctagg

SEQ ID NO: 10614 - DNA, 128 bp, Homo sapiens
  chr10:128076940-128077068
  hyper
cgttctggcacaagccagccttgaccgttgcaataaatgagcaaactgtccgagttggcccggggactaggaagagcgttagtgagagaaggcaggcctgtgaaatggatccacggccagcagtcacc

SEQ ID NO: 10615 - DNA, 17 bp, Homo sapiens
  chr10:128993505-128993522
  hyper
cgaccccgggctgcccg

SEQ ID NO: 10616 - DNA, 41 bp, Homo sapiens
  chr10:128993580-128993621
  hyper
cgttggttggtttcccacgcctgtcccggtctgactcgggc

SEQ ID NO: 10617 - DNA, 219 bp, Homo sapiens; identical to SEQ ID NO: 3678
  chr10:128993945-128994164
  hyper

SEQ ID NO: 10618 - DNA, 30 bp, Homo sapiens
  chr10:128994727-128994757
  hyper
gagggaagtcctttccgctgctccaggtcc

SEQ ID NO: 10619 - DNA, 51 bp, Homo sapiens
  chr10:129535122-129535173
  hyper
ggggccttgaggagtcgtggtacggtccagggcagtcggggctgcggggcc

SEQ ID NO: 10620 - DNA, 38 bp, Homo sapiens
  chr10:129535695-129535733
  hyper
cgcttcgggtcccgggcctgcgccgccctacgcggccc

SEQ ID NO: 10621 - DNA, 30 bp, Homo sapiens
  chr10:129536272-129536302
  hyper
ctctcaatctctgtgcgctccttcggagga

SEQ ID NO: 10622 - DNA, 124 bp, Homo sapiens
  chr10:129948016-129948140
  hyper
accgtcagctgccgccgacggagcccacagaggaggctcgggcgcccgcgccccctgcgcagcggcccctccgcagcggccccagcccgcgtccccgcagcgccccttccgaagcgccccctcc

SEQ ID NO: 10623 - DNA, 116 bp, Homo sapiens
  chr10:130008498-130008614
  hyper
cacagtaatcagaggcggcctttacaaatagattgcatttgaccttgttggtttgatggacgggagtggagtccggccgcggacggcgtcccttccagggccggccgccagagggc

SEQ ID NO: 10624 - DNA, 61 bp, Homo sapiens
  chr10:130008816-130008877
  hyper
gagactccacgtccacgtcccgggcagtccctccggaggttgggccgcgcggcccggggag

SEQ ID NO: 10625 - DNA, 73 bp, Homo sapiens
  chr10:130008906-130008979
  hyper
cggggcctttaggcgcccccgtttcctcgtcagtggggggcgcggtgccgcttctccgcgggctaaactgctg

SEQ ID NO: 10626 - DNA, 146 bp, Homo sapiens; identical to SEQ ID NO: 946
  chr10:130085053-130085199
  hyper

SEQ ID NO: 10627 - DNA, 76 bp, Homo sapiens; identical to SEQ ID NO: 947
  chr10:130085200-130085276
  hyper

SEQ ID NO: 10628 - DNA, 54 bp, Homo sapiens; identical to SEQ ID NO: 948
  chr10:130085355-130085409
  hyper

SEQ ID NO: 10629 - DNA, 98 bp, Homo sapiens
  chr10:130338828-130338926
  hyper
atgcccgctaggagccggcgccggggcgccccaaggctgcctccccccgcagcgctgcgcagtgcgccctggtgggatggggacgctgcacccctgaa

SEQ ID NO: 10630 - DNA, 30 bp, Homo sapiens
  chr10:130339734-130339764
  hyper
tgccggggatttcctcgggtgttggggaaa

SEQ ID NO: 10631 - DNA, 157 bp, Homo sapiens
  chr10:131761695-131761852
  hyper
cgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggc

SEQ ID NO: 10632 - DNA, 79 bp, Homo sapiens
  chr10:131762087-131762166
  hyper
gcgctcggggcttggcggcaggcggctgccctggccgccctcgccctgctcggcgcctgcggtccggccccgccgccgg

SEQ ID NO: 10633 - DNA, 698 bp, Homo sapiens; identical to SEQ ID NO: 3682
  chr10:131762639-131763337
  hyper

SEQ ID NO: 10634 - DNA, 780 bp, Homo sapiens; identical to SEQ ID NO: 3683
  chr10:131769496-131770276
  hyper

SEQ ID NO: 10635 - DNA, 491 bp, Homo sapiens
  chr10:131770603-131771094
  hyper
tgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctgg

SEQ ID NO: 10636 - DNA, 21 bp, Homo sapiens
  chr10:131771281-131771302
  hyper
gggagagcccacgggcccggc

SEQ ID NO: 10637 - DNA, 15 bp, Homo sapiens
  chr10:133109246-133109261
  hyper
atggacagtgacccc

SEQ ID NO: 10638 - DNA, 121 bp, Homo sapiens; identical to SEQ ID NO: 3684
  chr10:133110064-133110185
  hyper

SEQ ID NO: 10639 - DNA, 290 bp, Homo sapiens; identical to SEQ ID NO: 3685
  chr10:133110553-133110843
  hyper

SEQ ID NO: 10640 - DNA, 347 bp, Homo sapiens
  chr10:133794895-133795242
  hyper
gaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcc

SEQ ID NO: 10641 - DNA, 572 bp, Homo sapiens
  chr10:133795312-133795884
  hyper
cgccagagggcaactgcggcgatcggagtccgcgccgggctgcgggatgtgcttcagctgcgggcggtgggaaagcggaggtcggagcgccgcggcccagctgcgctcccggactgagcggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcctgaggtgagccggcccgggctggacgccgcgggccgcgtgacgagtgggctgcgcggtcgccgccgcggcgggcggtgggccgggttctcctttgaaggggcggtgggaccggcggactctctgggcactggctaccacggagacgccgctacgcttcggggcggggcccgtctttccatcctgctagtggggaaactgagg

SEQ ID NO: 10642 - DNA, 84 bp, Homo sapiens
  chr10:133795975-133796059
  hyper
cgcccggggcgggagctgcgagcggtgggccggagctgagcgtctcgggacgggaccgcgtccccgggtctttgcccgccccgc

SEQ ID NO: 10643 - DNA, 222 bp, Homo sapiens
  chr10:133849913-133850135
  hyper
tgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 10644 - DNA, 137 bp, Homo sapiens
  chr10:133850156-133850293
  hyper
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctg

SEQ ID NO: 10645 - DNA, 294 bp, Homo sapiens
  chr10:133850528-133850822
  hyper
ccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcc

SEQ ID NO: 10646 - DNA, 127 bp, Homo sapiens
  chr10:134000613-134000740
  hyper
cggtcccgcttcgcccggcgccccctgcccgccgcccggagtggggcctggacgccgggcggaccctcctggtcttgtgcgtgggtggggggtccctgcctttgcgtctggtccctgtcctggcgcc

SEQ ID NO: 10647 - DNA, 59 bp, Homo sapiens
  chr10:134000798-134000857
  hyper
cgcagacccccttaaggagcggggcgcccaggcccggcccggcccggccctgcccggcc

SEQ ID NO: 10648 - DNA, 57 bp, Homo sapiens
  chr10:134001139-134001196
  hyper
cgatttagccccggccgctctggccggagtccctggtggccccgaacccttccagta

SEQ ID NO: 10649 - DNA, 157 bp, Homo sapiens
  chr10:134120760-134120917
  hyper
aaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcg

SEQ ID NO: 10650 - DNA, 30 bp, Homo sapiens
  chr10:134122245-134122275
  hyper
atgcgacaggggcctcggcactcggcgtat

SEQ ID NO: 10651 - DNA, 81 bp, Homo sapiens
  chr10:134599431-134599512
  hyper
gcccgggcggttagtgtccatgggcgccgccgccgccggcccgggctcccatccgggccccgccgccgccgcccctgcccg

SEQ ID NO: 10652 - DNA, 30 bp, Homo sapiens
  chr10:134599761-134599791
  hyper
cccgcgcgcccccgccggccgcgcactcca

SEQ ID NO: 10653 - DNA, 253 bp, Homo sapiens
  chr10:134600301-134600554
  hyper
ggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccg

SEQ ID NO: 10654 - DNA, 160 bp, Homo sapiens
  chr10:134601556-134601716
  hyper
ccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagcc

SEQ ID NO: 10655 - DNA, 30 bp, Homo sapiens
  chr10:134602360-134602390
  hyper
gcgggggtgtcggcccggaaggagagccgg

SEQ ID NO: 10656 - DNA, 65 bp, Homo sapiens
  chr10:134676528-134676593
  hyper
gtccctgcaaaacagcggctgcaggaaggagggtggcgaacccacgttcgcgggagtccagcacc

SEQ ID NO: 10657 - DNA, 91 bp, Homo sapiens
  chr10:134901183-134901274
  hyper
ggaataacacagggtcgtgcagtccgcccggcggcgttttcgggcgagggtctggtgctggggagcgagcgcggagcgaggtgtctcttta

SEQ ID NO: 10658 - DNA, 117 bp, Homo sapiens
  chr10:134902008-134902125
  hyper
catctgccgctggcgcgttcggtccgagccccccaccggtccccaccggcaccgcctccgccagccccaggcgcagcccccaggccgcccgcggaggggagggagcgacaggggccg

SEQ ID NO: 10659 - DNA, 42 bp, Homo sapiens
  chr10:134974307-134974349
  hyper
cgcggtagctcctggtggaaaccctggcgggacagtgtgggg

SEQ ID NO: 10660 - DNA, 291 bp, Homo sapiens
  chr10:135043335-135043626
  hyper
tgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 10661 - DNA, 172 bp, Homo sapiens
  chr10:135043826-135043998
  hyper
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacgga

SEQ ID NO: 10662 - DNA, 120 bp, Homo sapiens; identical to SEQ ID NO: 3686
  chr10:135044554-135044674
  hyper

SEQ ID NO: 10663 - DNA, 239 bp, Homo sapiens
  chr10:135048918-135049157
  hyper
tgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggag

SEQ ID NO: 10664 - DNA, 56 bp, Homo sapiens
  chr10:135049727-135049783
  hyper
aggcatctgggccctcgctgcccctggccgggacacactgccggtcctgtgcagtg

SEQ ID NO: 10665 - DNA, 334 bp, Homo sapiens
  chr10:135050388-135050722
  hyper
tcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctc

SEQ ID NO: 10666 - DNA, 603 bp, Homo sapiens
  chr10:135138981-135139584
  hyper
ggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccg

SEQ ID NO: 10667 - DNA, 100 bp, Homo sapiens
  chr10:135148986-135149086
  hyper
caacgcagacaggcccgagacgcgtcttcaggaagaaaaagccattgggggcccactggagcctcgcttctggttccgggcccagcgccccgggcggaat

SEQ ID NO: 10668 - DNA, 30 bp, Homo sapiens
  chr11:308110-308140
  hyper
aaactgttgagaaaacggaactactgggga

SEQ ID NO: 10669 - DNA, 166 bp, Homo sapiens
  chr11:406876-407042
  hyper
aggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccaccc

SEQ ID NO: 10670 - DNA, 30 bp, Homo sapiens
  chr11:407401-407431
  hyper
gcacggggtggggcccgggataccagcgcg

SEQ ID NO: 10671 - DNA, 5 bp, Homo sapiens
  chr11:637259-637264
  hyper
cgacc

SEQ ID NO: 10672 - DNA, 118 bp, Homo sapiens; identical to SEQ ID NO: 3688
  chr11:637349-637467
  hyper

SEQ ID NO: 10673 - DNA, 150 bp, Homo sapiens
  chr11:726316-726466
  hyper
catggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagc

SEQ ID NO: 10674 - DNA, 138 bp, Homo sapiens
  chr11:1410132-1410270
  hyper
cgggaggcgccagggcgctgcggccggatcccaggtgagttccttgactccgcgccgcgcaggtcactgtggcataactgggaaaaccgccgcttctccctcgggagcggaggcggagggccacgtcctccctggggg

SEQ ID NO: 10675 - DNA, 34 bp, Homo sapiens
  chr11:1411655-1411689
  hyper
gcgctgggtggggggcgcccgagggaggccccgg

SEQ ID NO: 10676 - DNA, 30 bp, Homo sapiens
  chr11:1412279-1412309
  hyper
gtggagggggcttcccggtggggcctggct

SEQ ID NO: 10677 - DNA, 379 bp, Homo sapiens
  chr11:1770262-1770641
  hyper
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtc

SEQ ID NO: 10678 - DNA, 45 bp, Homo sapiens
  chr11:2291449-2291494
  hyper
cgccgccggctgcagcgcaacagttccggggacgcgggtctccgc

SEQ ID NO: 10679 - DNA, 48 bp, Homo sapiens
  chr11:2292010-2292058
  hyper
cacagatccccagtgcgcccaactggcgaaatctgcgagttcccggtg

SEQ ID NO: 10680 - DNA, 255 bp, Homo sapiens
  chr11:2292105-2292360
  hyper
cgcaggtcctgggttgagccttcccgtacccccaccctaaccccgcgcgcagccccgccagtcccaagagccgccagaccttcgcacgcgcagcgcgcgctgtgggagggaaggcgcggccctggcgacaacacggctgttcgggaggcgcgcaagatccccgggggcagcacgcgccgcgcagcccacacccacgccccaccctcctggggccgaggaggcgggggccagggtctcagccaatcgtgggccacc

SEQ ID NO: 10681 - DNA, 326 bp, Homo sapiens
  chr11:2292391-2292717
  hyper
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtg

SEQ ID NO: 10682 - DNA, 86 bp, Homo sapiens
  chr11:2883674-2883760
  hyper
ggcgggggccggggtcgggggtccggcgagctttaatgcgcgcacaaagcctcatttgcaggtcaatgccgcggcacactcgcctc

SEQ ID NO: 10683 - DNA, 156 bp, Homo sapiens
  chr11:6280445-6280601
  hyper
gagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctc

SEQ ID NO: 10684 - DNA, 51 bp, Homo sapiens
  chr11:6281269-6281320
  hyper
agctgcgagccccctcgcattcgcggagccgggacacgaggtgggtgcctc

SEQ ID NO: 10685 - DNA, 104 bp, Homo sapiens
  chr11:6676726-6676830
  hyper
cagcccaggggaggccggcgggcagggcgggcgcggccagacgggccgggcgggcgcgggcactgacctccgcgcgacgcgggctccctcgcccggtgctgggg

SEQ ID NO: 10686 - DNA, 84 bp, Homo sapiens
  chr11:6677244-6677328
  hyper
gccgcgccgcgcccccgtcccggttcccttcccttctccccgtcacttctcccgtcctctcctcccattcggttctctacgccc

SEQ ID NO: 10687 - DNA, 614 bp, Homo sapiens
  chr11:6947606-6948220
  hyper
gttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggt

SEQ ID NO: 10688 - DNA, 30 bp, Homo sapiens
  chr11:7273118-7273148
  hyper
gcgcaagcagagaggcgctctgggctgtgc

SEQ ID NO: 10689 - DNA, 33 bp, Homo sapiens
  chr11:7274215-7274248
  hyper
tggggttcgtagactcgtcggtcctggcttgtg

SEQ ID NO: 10690 - DNA, 38 bp, Homo sapiens
  chr11:8040298-8040336
  hyper
ctggggaagaagggacggggagacggcgggaatctagg

SEQ ID NO: 10691 - DNA, 77 bp, Homo sapiens
  chr11:8040699-8040776
  hyper
cgccattggcagagccggagggggtcaccccccggggggcgaatggtacagtcctccgcccgcgcctcggccgggcc

SEQ ID NO: 10692 - DNA, 67 bp, Homo sapiens
  chr11:8041504-8041571
  hyper
atggcgagcggctgccggcgtgggcggtttggagctgcgctccccacgcactcgtcctggaggaagg

SEQ ID NO: 10693 - DNA, 344 bp, Homo sapiens
  chr11:8102616-8102960
  hyper
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatg

SEQ ID NO: 10694 - DNA, 794 bp, Homo sapiens; identical to SEQ ID NO: 3689
  chr11:8189946-8190740
  hyper

SEQ ID NO: 10695 - DNA, 35 bp, Homo sapiens
  chr11:8284256-8284291
  hyper
gagacagggagctagcgggccggcacaagaggcgg

SEQ ID NO: 10696 - DNA, 41 bp, Homo sapiens
  chr11:8284611-8284652
  hyper
cagtgcacagctcctcggctcgcggccgggacccggggggc

SEQ ID NO: 10697 - DNA, 39 bp, Homo sapiens
  chr11:8284896-8284935
  hyper
ccagcaccatcatctcgggcgctccgtgtccagccgcag

SEQ ID NO: 10698 - DNA, 245 bp, Homo sapiens
  chr11:8289527-8289772
  hyper
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgct

SEQ ID NO: 10699 - DNA, 201 bp, Homo sapiens
  chr11:8290057-8290258
  hyper
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcc

SEQ ID NO: 10700 - DNA, 30 bp, Homo sapiens
  chr11:8615288-8615318
  hyper
accccacagtaagttcgcttctaaactttc

SEQ ID NO: 10701 - DNA, 1027 bp, Homo sapiens
  chr11:9025080-9026107
  hyper
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccacc

SEQ ID NO: 10702 - DNA, 140 bp, Homo sapiens; identical to SEQ ID NO: 3690
  chr11:9112446-9112586
  hyper

SEQ ID NO: 10703 - DNA, 307 bp, Homo sapiens; identical to SEQ ID NO: 3691
  chr11:9112639-9112946
  hyper

SEQ ID NO: 10704 - DNA, 341 bp, Homo sapiens
  chr11:12029931-12030272
  hyper
gcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 10705 - DNA, 194 bp, Homo sapiens
  chr11:12030273-12030467
  hyper
gagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgct

SEQ ID NO: 10706 - DNA, 61 bp, Homo sapiens
  chr11:13031258-13031319
  hyper
cagcggcggagccggcggctggggtcggccggcgacccgcatggcccgggagagctgcccg

SEQ ID NO: 10707 - DNA, 326 bp, Homo sapiens; identical to SEQ ID NO: 3692
  chr11:15136101-15136427
  hyper

SEQ ID NO: 10708 - DNA, 59 bp, Homo sapiens
  chr11:16626111-16626170
  hyper
ccattgacagtacagcgggaggtccggagcccagcccagtttgccgcaaggacggcttc

SEQ ID NO: 10709 - DNA, 70 bp, Homo sapiens; identical to SEQ ID NO: 3693
  chr11:16632513-16632583
  hyper

SEQ ID NO: 10710 - DNA, 53 bp, Homo sapiens
  chr11:16634305-16634358
  hyper
tcccctctaatgagacgcggatcaccctccactctcaccgacactgcagctct

SEQ ID NO: 10711 - DNA, 29 bp, Homo sapiens
  chr11:17497492-17497521
  hyper
ctttgcaagcaagggcgccggggtcgctg

SEQ ID NO: 10712 - DNA, 116 bp, Homo sapiens; identical to SEQ ID NO: 3695
  chr11:17497545-17497661
  hyper

SEQ ID NO: 10713 - DNA, 143 bp, Homo sapiens
  chr11:17498038-17498181
  hyper
cagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatga

SEQ ID NO: 10714 - DNA, 49 bp, Homo sapiens
  chr11:17717486-17717535
  hyper
ggggaggcgcgtggccggccgcccccagctgtggcgtcgttcaggcccg

SEQ ID NO: 10715 - DNA, 156 bp, Homo sapiens
  chr11:17740414-17740570
  hyper
agctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcac

SEQ ID NO: 10716 - DNA, 39 bp, Homo sapiens
  chr11:17741123-17741162
  hyper
gaggaagccctggggcgctgccgccgctttccttaacca

SEQ ID NO: 10717 - DNA, 84 bp, Homo sapiens; identical to SEQ ID NO: 949
  chr11:17741806-17741890
  hyper

SEQ ID NO: 10718 - DNA, 135 bp, Homo sapiens; identical to SEQ ID NO: 950
  chr11:17741952-17742087
  hyper

SEQ ID NO: 10719 - DNA, 84 bp, Homo sapiens
  chr11:17742361-17742445
  hyper
gagttagggagggggcggctacaggaattggtgttcgggcctcgagccgtcccgcgggcctgactcagtcgcccttgctgtttg

SEQ ID NO: 10720 - DNA, 33 bp, Homo sapiens
  chr11:17743742-17743775
  hyper
ccagctgtccctcagcgacgcctgtaggcggca

SEQ ID NO: 10721 - DNA, 72 bp, Homo sapiens
  chr11:17756900-17756972
  hyper
ccggagcccgccctgcgtcccgagctgcagcccggccacgcagggaggaaggcaggcggcatccatctcccc

SEQ ID NO: 10722 - DNA, 15 bp, Homo sapiens
  chr11:17756993-17757008
  hyper
cgaccacctcacaga

SEQ ID NO: 10723 - DNA, 53 bp, Homo sapiens
  chr11:17757704-17757757
  hyper
tgacgagttcttcttcgaccgccaccccggcgtcttcgcgcacatcctgaact

SEQ ID NO: 10724 - DNA, 306 bp, Homo sapiens
  chr11:18742729-18743035
  hyper
cgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccc

SEQ ID NO: 10725 - DNA, 96 bp, Homo sapiens
  chr11:18812557-18812653
  hyper
gctgggggaggggagcgcgctaagcttgtattctaggggagggtgggacgcgggaggctaaagctaaagggtcggtggaggcgaagcaatgggaag

SEQ ID NO: 10726 - DNA, 272 bp, Homo sapiens
  chr11:18812894-18813166
  hyper
ccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgctt

SEQ ID NO: 10727 - DNA, 132 bp, Homo sapiens
  chr11:18813376-18813508
  hyper
ccccagccccggctccgccccgcccccgggcgggcttccgccgctcgccgggaattgcgcagggctggcggggcgggggaccgggagagcggcctgctcccggggcacgaagggggccggatcacagaccct

SEQ ID NO: 10728 - DNA, 224 bp, Homo sapiens; identical to SEQ ID NO: 3698
  chr11:18813811-18814035
  hyper

SEQ ID NO: 10729 - DNA, 62 bp, Homo sapiens
  chr11:19366698-19366760
  hyper
gcactggttggctggcgggagggaggaggaggcggtttcccgggtaacgggagggcaaggag

SEQ ID NO: 10730 - DNA, 157 bp, Homo sapiens
  chr11:19366978-19367135
  hyper
ctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 10731 - DNA, 92 bp, Homo sapiens
  chr11:19367267-19367359
  hyper
cgggggcgcactttcccggcctccagcgacactgcgcacgcccctatccggagtgggtgtgtgtccctctgggcgtacgtgcctgaggctgt

SEQ ID NO: 10732 - DNA, 39 bp, Homo sapiens
  chr11:19367898-19367937
  hyper
ggatccgagccaagccgggggcaactaggccaggcctgc

SEQ ID NO: 10733 - DNA, 39 bp, Homo sapiens
  chr11:19367938-19367977
  hyper
gttcccctggctctcgctctcccacgctccggttagctg

SEQ ID NO: 10734 - DNA, 30 bp, Homo sapiens
  chr11:19735404-19735434
  hyper
agatccccctgaaatcgcaggtgctgcagg

SEQ ID NO: 10735 - DNA, 192 bp, Homo sapiens
  chr11:20153699-20153891
  hyper
ccgcccatccacattcggcctggcaccgatcctgcggaatctctccccaacgcacggtttctacactggaacgattgaaactaagggggtgcgccaactcccccaccttcgcgggtcccctggcaggagacctggtccttgccttaccgcagtaggtgtggctgtgactgaagggagcggcatccctgagca

SEQ ID NO: 10736 - DNA, 73 bp, Homo sapiens
  chr11:20177730-20177803
  hyper
aaaatagtactctggcgtgcgagcggcttctaggacacggtgatttcctcctgttcctcgccctcctcttcct

SEQ ID NO: 10737 - DNA, 385 bp, Homo sapiens; identical to SEQ ID NO: 3699
  chr11:20178093-20178478
  hyper

SEQ ID NO: 10738 - DNA, 200 bp, Homo sapiens
  chr11:20178700-20178900
  hyper
cgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctcc

SEQ ID NO: 10739 - DNA, 63 bp, Homo sapiens
  chr11:20180763-20180826
  hyper
gctgaaaagacccttcgaagtagggaaaggcgaaggtcttgggagggacgctctggagcaagg

SEQ ID NO: 10740 - DNA, 101 bp, Homo sapiens; identical to SEQ ID NO: 3700
  chr11:20181185-20181286
  hyper

SEQ ID NO: 10741 - DNA, 98 bp, Homo sapiens
  chr11:20181895-20181993
  hyper
ccttctttcagtggccggagggtaaacgcctcgcttcccgcccctcccgcccccacagtgtcctctctcttgggcttagcaaacgtctccaagtaaca

SEQ ID NO: 10742 - DNA, 34 bp, Homo sapiens
  chr11:20182878-20182912
  hyper
gcggcgctgggctgccgagcggcaggattccgct

SEQ ID NO: 10743 - DNA, 30 bp, Homo sapiens
  chr11:20183391-20183421
  hyper
agaagtgtgcagccccgccaggccgccctg

SEQ ID NO: 10744 - DNA, 80 bp, Homo sapiens; identical to SEQ ID NO: 3701
  chr11:20183674-20183754
  hyper

SEQ ID NO: 10745 - DNA, 32 bp, Homo sapiens
  chr11:20184112-20184144
  hyper
cagttcccagaaggacgcgccgggggcttcag

SEQ ID NO: 10746 - DNA, 190 bp, Homo sapiens; identical to SEQ ID NO: 3702
  chr11:20184500-20184690
  hyper

SEQ ID NO: 10747 - DNA, 531 bp, Homo sapiens; identical to SEQ ID NO: 3703
  chr11:20184899-20185430
  hyper

SEQ ID NO: 10748 - DNA, 344 bp, Homo sapiens; identical to SEQ ID NO: 951
  chr11:20229223-20229567
  hyper

SEQ ID NO: 10749 - DNA, 39 bp, Homo sapiens
  chr11:20230466-20230505
  hyper
ttgctgcttttgagccggttgcttcgggccggcagccct

SEQ ID NO: 10750 - DNA, 30 bp, Homo sapiens; identical to SEQ ID NO: 952
  chr11:20618363-20618393
  hyper

SEQ ID NO: 10751 - DNA, 503 bp, Homo sapiens; identical to SEQ ID NO: 953
  chr11:20618422-20618925
  hyper

SEQ ID NO: 10752 - DNA, 567 bp, Homo sapiens
  chr11:20619407-20619974
  hyper
agcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 10753 - DNA, 50 bp, Homo sapiens; identical to SEQ ID NO: 3707
  chr11:20621603-20621653
  hyper

SEQ ID NO: 10754 - DNA, 101 bp, Homo sapiens; identical to SEQ ID NO: 954
  chr11:20623258-20623359
  hyper

SEQ ID NO: 10755 - DNA, 182 bp, Homo sapiens
  chr11:20690653-20690835
  hyper
ggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcg

SEQ ID NO: 10756 - DNA, 26 bp, Homo sapiens
  chr11:20691060-20691086
  hyper
gccagcggtggggggcgggctggggg

SEQ ID NO: 10757 - DNA, 40 bp, Homo sapiens; identical to SEQ ID NO: 956
  chr11:20691121-20691161
  hyper

SEQ ID NO: 10758 - DNA, 218 bp, Homo sapiens; identical to SEQ ID NO: 957
  chr11:20691162-20691380
  hyper

SEQ ID NO: 10759 - DNA, 185 bp, Homo sapiens; identical to SEQ ID NO: 958
  chr11:20691431-20691616
  hyper

SEQ ID NO: 10760 - DNA, 90 bp, Homo sapiens; identical to SEQ ID NO: 959
  chr11:20691747-20691837
  hyper

SEQ ID NO: 10761 - DNA, 36 bp, Homo sapiens
  chr11:20692310-20692346
  hyper
tacccagccatcctccgtacgcgctgcaccccagaa

SEQ ID NO: 10762 - DNA, 30 bp, Homo sapiens
  chr11:20692851-20692881
  hyper
gctactggctctgagcgcgagagtctggtg

SEQ ID NO: 10763 - DNA, 386 bp, Homo sapiens
  chr11:22214443-22214829
  hyper
gcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaagg

SEQ ID NO: 10764 - DNA, 105 bp, Homo sapiens; identical to SEQ ID NO: 3714
  chr11:22215182-22215287
  hyper

SEQ ID NO: 10765 - DNA, 15 bp, Homo sapiens
  chr11:22359403-22359418
  hyper
tcttttatttactca

SEQ ID NO: 10766 - DNA, 105 bp, Homo sapiens
  chr11:22359777-22359882
  hyper
ccgtggcactgcttgcgctctttgccaccggatcctccccttccaatgagactttctgattgtgtctaccaactctcctattaggaaacccgtgggttgcatgca

SEQ ID NO: 10767 - DNA, 355 bp, Homo sapiens
  chr11:22362533-22362888
  hyper
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacct

SEQ ID NO: 10768 - DNA, 215 bp, Homo sapiens
  chr11:22364821-22365036
  hyper
cgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtc

SEQ ID NO: 10769 - DNA, 140 bp, Homo sapiens; identical to SEQ ID NO: 3715
  chr11:22365407-22365547
  hyper

SEQ ID NO: 10770 - DNA, 30 bp, Homo sapiens
  chr11:22688349-22688379
  hyper
gtgcctggagggggccggccccgagaagct

SEQ ID NO: 10771 - DNA, 197 bp, Homo sapiens; identical to SEQ ID NO: 960
  chr11:27743436-27743633
  hyper

SEQ ID NO: 10772 - DNA, 443 bp, Homo sapiens
  chr11:27743897-27744340
  hyper
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtg

SEQ ID NO: 10773 - DNA, 71 bp, Homo sapiens
  chr11:27744656-27744727
  hyper
tgttatggagatgtccgtcgctctgaggagcgctagtgccctgggaagtccccagacgcatttcaggtttc

SEQ ID NO: 10774 - DNA, 15 bp, Homo sapiens
  chr11:30037737-30037752
  hyper
ccaaaagaagggaac

SEQ ID NO: 10775 - DNA, 195 bp, Homo sapiens
  chr11:30038294-30038489
  hyper
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaag

SEQ ID NO: 10776 - DNA, 37 bp, Homo sapiens
  chr11:30038919-30038956
  hyper
ctctatatctcccctcgagccccgagccccgtcttct

SEQ ID NO: 10777 - DNA, 71 bp, Homo sapiens
  chr11:30040131-30040202
  hyper
ataaccagaagcccacgtggcgacggggtctccctagacacctctcccagctcgcccgatggaccaagcag

SEQ ID NO: 10778 - DNA, 34 bp, Homo sapiens
  chr11:30605841-30605875
  hyper
ggtggtgggcagttgcgcgaggcggggtgggggg

SEQ ID NO: 10779 - DNA, 91 bp, Homo sapiens
  chr11:30605935-30606026
  hyper
gccctgcccttctaggctcacggctggctcttcccggctacaacttccccttccttcctgaaacaccagcgccttactcgctcagtccccc

SEQ ID NO: 10780 - DNA, 1 bp, Homo sapiens
  chr11:30606027-30606028
  hyper
t

SEQ ID NO: 10781 - DNA, 30 bp, Homo sapiens
  chr11:30606351-30606381
  hyper
aagggagggagccagcgagcgttggaaggg

SEQ ID NO: 10782 - DNA, 15 bp, Homo sapiens
  chr11:30606740-30606755
  hyper
tgtagagaagaaatc

SEQ ID NO: 10783 - DNA, 292 bp, Homo sapiens; identical to SEQ ID NO: 3718
  chr11:30606795-30607087
  hyper

SEQ ID NO: 10784 - DNA, 363 bp, Homo sapiens
  chr11:30607367-30607730
  hyper
gaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttc

SEQ ID NO: 10785 - DNA, 55 bp, Homo sapiens
  chr11:31818458-31818513
  hyper
ctccgctcacgtgtgcgggcacaagcgtctgtgctaatttactgccccaagtttc

SEQ ID NO: 10786 - DNA, 1042 bp, Homo sapiens; identical to SEQ ID NO: 961
  chr11:31819319-31820361
  hyper

SEQ ID NO: 10787 - DNA, 565 bp, Homo sapiens; identical to SEQ ID NO: 962
  chr11:31820460-31821025
  hyper

SEQ ID NO: 10788 - DNA, 36 bp, Homo sapiens
  chr11:31821352-31821388
  hyper
cacgtcccattatcccgcatattatctccttgtcac

SEQ ID NO: 10789 - DNA, 143 bp, Homo sapiens
  chr11:31821389-31821532
  hyper
aggacaacaaataccgattaatcttcggagtaaactgtttcctattcttgaccaagctacctcggggtgtggaggggagcggaggggagccaactgaccctcccctccgccccaccccccccatcccccgctcttcttcctcc

SEQ ID NO: 10790 - DNA, 30 bp, Homo sapiens
  chr11:31822002-31822032
  hyper
cagccaccttcataccgctcctgacataca

SEQ ID NO: 10791 - DNA, 221 bp, Homo sapiens
  chr11:31822487-31822708
  hyper
aagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 10792 - DNA, 718 bp, Homo sapiens; identical to SEQ ID NO: 3721
  chr11:31824246-31824964
  hyper

SEQ ID NO: 10793 - DNA, 29 bp, Homo sapiens
  chr11:31826042-31826071
  hyper
acaggcgtttgggggatctgggctccggc

SEQ ID NO: 10794 - DNA, 198 bp, Homo sapiens; identical to SEQ ID NO: 964
  chr11:31826106-31826304
  hyper

SEQ ID NO: 10795 - DNA, 325 bp, Homo sapiens; identical to SEQ ID NO: 965
  chr11:31826408-31826733
  hyper

SEQ ID NO: 10796 - DNA, 117 bp, Homo sapiens; identical to SEQ ID NO: 966
  chr11:31827113-31827230
  hyper

SEQ ID NO: 10797 - DNA, 457 bp, Homo sapiens; identical to SEQ ID NO: 967
  chr11:31827597-31828054
  hyper

SEQ ID NO: 10798 - DNA, 329 bp, Homo sapiens
  chr11:31829116-31829445
  hyper
taacttctcttttggcgtttagatcttcacccctttaactgtactgtgacacaccctgtctacctcgcctcactgctttaaaaagtacgaacaggagggggtgagcgtggtcgacaaagccgacagacggcaaacaatggcttctattctccagctttcctcgaacccaaggagcaaaaccgagtctccctaaccagcaacacagcttccaaccaaatgtaccaacaacccaccaactcacaaagggaacagagggacgcttctagcttcataagccctgacccagtgcaggggtccccgaggctgctcccgtacgaacacctccctac

SEQ ID NO: 10799 - DNA, 56 bp, Homo sapiens
  chr11:31830319-31830375
  hyper
aattacttaagtaaacgtgaacactaagtgcagaagcaacccgggaagtggggcac

SEQ ID NO: 10800 - DNA, 75 bp, Homo sapiens
  chr11:31831502-31831577
  hyper
aagggagatgagagtcgggggaagcctggggagcagagagttttcaagttccgagctcagcgctccagtggagtt

SEQ ID NO: 10801 - DNA, 50 bp, Homo sapiens
  chr11:31832795-31832845
  hyper
gcgcctgaaccagagcgggaaatgaggccgagccacggttcccttttcaa

SEQ ID NO: 10802 - DNA, 49 bp, Homo sapiens
  chr11:31833553-31833602
  hyper
tctcctttctcctttcggaagccgcggtgcgcagcggagcagaggcaca

SEQ ID NO: 10803 - DNA, 149 bp, Homo sapiens
  chr11:31834086-31834235
  hyper
ccatttgttgaatgccgcacgattaggacacacctcagtacactccaaaggcgcccctcggagcctgcagttaaggtgacaggagagcgagcggctgcctggtcctgcgctgtcccgagctctctcggcggcttcgggccacggagccg

SEQ ID NO: 10804 - DNA, 30 bp, Homo sapiens
  chr11:31835312-31835342
  hyper
accccagaatgaggccgagttttcaaagtt

SEQ ID NO: 10805 - DNA, 220 bp, Homo sapiens; identical to SEQ ID NO: 3727
  chr11:31835591-31835811
  hyper

SEQ ID NO: 10806 - DNA, 438 bp, Homo sapiens; identical to SEQ ID NO: 968
  chr11:31836032-31836470
  hyper

SEQ ID NO: 10807 - DNA, 159 bp, Homo sapiens; identical to SEQ ID NO: 969
  chr11:31837354-31837513
  hyper

SEQ ID NO: 10808 - DNA, 735 bp, Homo sapiens; identical to SEQ ID NO: 970
  chr11:31837541-31838276
  hyper

SEQ ID NO: 10809 - DNA, 1227 bp, Homo sapiens; identical to SEQ ID NO: 3731
  chr11:31838719-31839946
  hyper

SEQ ID NO: 10810 - DNA, 132 bp, Homo sapiens; identical to SEQ ID NO: 3732
  chr11:31840041-31840173
  hyper

SEQ ID NO: 10811 - DNA, 315 bp, Homo sapiens; identical to SEQ ID NO: 971
  chr11:31841774-31842089
  hyper

SEQ ID NO: 10812 - DNA, 51 bp, Homo sapiens
  chr11:31846162-31846213
  hyper
tcacaaatataatatcggcagctcccggattgcctgcggggttgttcaggc

SEQ ID NO: 10813 - DNA, 94 bp, Homo sapiens
  chr11:31846434-31846528
  hyper
ccacatccaacttgtcgcagccccacgttcaggcacaggagggagcgaacattgggcagagggtaatttcaacaaaggacggcaggctccgggg

SEQ ID NO: 10814 - DNA, 204 bp, Homo sapiens
  chr11:31846781-31846985
  hyper
aaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactt

SEQ ID NO: 10815 - DNA, 30 bp, Homo sapiens
  chr11:31847250-31847280
  hyper
tttcttcccctcccccgaacttattctgaa

SEQ ID NO: 10816 - DNA, 229 bp, Homo sapiens; identical to SEQ ID NO: 3734
  chr11:31847484-31847713
  hyper

SEQ ID NO: 10817 - DNA, 104 bp, Homo sapiens; identical to SEQ ID NO: 3735
  chr11:31847769-31847873
  hyper

SEQ ID NO: 10818 - DNA, 76 bp, Homo sapiens; identical to SEQ ID NO: 3736
  chr11:31847895-31847971
  hyper

SEQ ID NO: 10819 - DNA, 248 bp, Homo sapiens; identical to SEQ ID NO: 3737
  chr11:31848355-31848603
  hyper

SEQ ID NO: 10820 - DNA, 353 bp, Homo sapiens; identical to SEQ ID NO: 3738
  chr11:31848722-31849075
  hyper

SEQ ID NO: 10821 - DNA, 15 bp, Homo sapiens
  chr11:32009112-32009127
  hyper
ccagccccggggtgg

SEQ ID NO: 10822 - DNA, 32 bp, Homo sapiens
  chr11:32455602-32455634
  hyper
ttctgtattaccatacgcgggagctatccacg

SEQ ID NO: 10823 - DNA, 110 bp, Homo sapiens; identical to SEQ ID NO: 972
  chr11:32455906-32456016
  hyper

SEQ ID NO: 10824 - DNA, 84 bp, Homo sapiens
  chr11:32456305-32456389
  hyper
acatcctggcctggccggatgacgcctggctgggcggaggaggaccgaagggcccgtagcgacaggctccggctgtgccagtga

SEQ ID NO: 10825 - DNA, 154 bp, Homo sapiens; identical to SEQ ID NO: 3740
  chr11:32456758-32456912
  hyper

SEQ ID NO: 10826 - DNA, 156 bp, Homo sapiens; identical to SEQ ID NO: 3741
  chr11:32456913-32457069
  hyper

SEQ ID NO: 10827 - DNA, 916 bp, Homo sapiens; identical to SEQ ID NO: 3742
  chr11:32457851-32458767
  hyper

SEQ ID NO: 10828 - DNA, 30 bp, Homo sapiens
  chr11:32459780-32459810
  hyper
actcacagcctagcacgaaggcaggtagca

SEQ ID NO: 10829 - DNA, 41 bp, Homo sapiens
  chr11:32460848-32460889
  hyper
ccggggcccgcgccccgagccccacgcgcaagacagcccaa

SEQ ID NO: 10830 - DNA, 155 bp, Homo sapiens; identical to SEQ ID NO: 3743
  chr11:33890297-33890452
  hyper

SEQ ID NO: 10831 - DNA, 91 bp, Homo sapiens
  chr11:35440574-35440665
  hyper
ggacgccggggtgagcgcgaagtgcggccgggagcggtatttaagaggagcctctgcccgcccttccacccgcctccggggtaagcccttt

SEQ ID NO: 10832 - DNA, 146 bp, Homo sapiens
  chr11:35441295-35441441
  hyper
gtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttc

SEQ ID NO: 10833 - DNA, 549 bp, Homo sapiens
  chr11:35641053-35641602
  hyper
cgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacc

SEQ ID NO: 10834 - DNA, 52 bp, Homo sapiens
  chr11:36399257-36399309
  hyper
ttgtcagcagttaggcggtgagtatttatagacgccacggcagtcctgcggt

SEQ ID NO: 10835 - DNA, 44 bp, Homo sapiens
  chr11:40314716-40314760
  hyper
aatttcataatctcacgttaaatggagtgcggggggcgggggcg

SEQ ID NO: 10836 - DNA, 93 bp, Homo sapiens
  chr11:40315465-40315558
  hyper
cggtttgaactctcttcctccccctccctctgctctctcccctctttttctcccaaataaatgctctcccagcaccggcggcagctcttgcca

SEQ ID NO: 10837 - DNA, 62 bp, Homo sapiens
  chr11:43569013-43569075
  hyper
ggttgcctggcaacccggcagacccgcgggtggacaagctcaaggggcagccaggtgccacc

SEQ ID NO: 10838 - DNA, 110 bp, Homo sapiens
  chr11:43569128-43569238
  hyper
cgagcgcagccggagcagtcgagcgggcaggacaccgtcagtgccgggagaacacgcgcgcgtgggtggatggcgggagggtcctcacagccagccgcaccacccccctc

SEQ ID NO: 10839 - DNA, 54 bp, Homo sapiens
  chr11:43596489-43596543
  hyper
ggtgagtttcctcttcgggtggagagcagaggggaaagccgcagtagcaagccg

SEQ ID NO: 10840 - DNA, 30 bp, Homo sapiens
  chr11:43599075-43599105
  hyper
tgaaagatttctcctcggtgatggtgactc

SEQ ID NO: 10841 - DNA, 287 bp, Homo sapiens
  chr11:43600516-43600803
  hyper
aaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctc

SEQ ID NO: 10842 - DNA, 240 bp, Homo sapiens
  chr11:43601012-43601252
  hyper
cagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgct

SEQ ID NO: 10843 - DNA, 454 bp, Homo sapiens; identical to SEQ ID NO: 973
  chr11:43602393-43602847
  hyper

SEQ ID NO: 10844 - DNA, 189 bp, Homo sapiens; identical to SEQ ID NO: 974
  chr11:43602848-43603037
  hyper

SEQ ID NO: 10845 - DNA, 112 bp, Homo sapiens; identical to SEQ ID NO: 975
  chr11:43603076-43603188
  hyper

SEQ ID NO: 10846 - DNA, 40 bp, Homo sapiens; identical to SEQ ID NO: 3747
  chr11:43603446-43603486
  hyper

SEQ ID NO: 10847 - DNA, 438 bp, Homo sapiens
  chr11:43603708-43604146
  hyper
caaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctg

SEQ ID NO: 10848 - DNA, 31 bp, Homo sapiens
  chr11:43963534-43963565
  hyper
agggaagggaagaaccggaatggaataatcg

SEQ ID NO: 10849 - DNA, 30 bp, Homo sapiens
  chr11:43963625-43963655
  hyper
gcgcgcgcgcgcctgcggaggggggtggca

SEQ ID NO: 10850 - DNA, 198 bp, Homo sapiens
  chr11:43964453-43964651
  hyper
catggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggt

SEQ ID NO: 10851 - DNA, 357 bp, Homo sapiens
  chr11:43964895-43965252
  hyper
cccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacactttta

SEQ ID NO: 10852 - DNA, 162 bp, Homo sapiens
  chr11:43965899-43966061
  hyper
ccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 10853 - DNA, 81 bp, Homo sapiens; identical to SEQ ID NO: 976
  chr11:44330877-44330958
  hyper

SEQ ID NO: 10854 - DNA, 481 bp, Homo sapiens; identical to SEQ ID NO: 977
  chr11:44330959-44331440
  hyper

SEQ ID NO: 10855 - DNA, 229 bp, Homo sapiens; identical to SEQ ID NO: 978
  chr11:44331482-44331711
  hyper

SEQ ID NO: 10856 - DNA, 30 bp, Homo sapiens
  chr11:44332542-44332572
  hyper
tgggctgggatgtagcggaatctgtgctcc

SEQ ID NO: 10857 - DNA, 122 bp, Homo sapiens
  chr11:44332922-44333044
  hyper
agggaaaaaactttgcgcgtgcagcccctcgatttcgcttcatgacaaccgtgctagagattggcgcccccaattttctgatgagctaacggaggctcagagaggggcggccacctggtcca

SEQ ID NO: 10858 - DNA, 136 bp, Homo sapiens
  chr11:44337726-44337862
  hyper
cgcgcgggtcctcggcgcgctcgccagacccagccgaccgcgtgactcaccacgtcctccgccgggaggaggtcagcatcggccctgggcaccggtccccagccgccgcagcccctgccccaatctccccggaatg

SEQ ID NO: 10859 - DNA, 176 bp, Homo sapiens
  chr11:44337882-44338058
  hyper
cgagcctccagtcggatagaggcagggagggaggcactgcccacgacgagtgctctccaggcgctgcaaagagcaggggtctcctaggggctttgagaccgcgggcggacctcgggggagcaggcgtgggacccgatctgtgccggctcagcagggccccagcagcgccccagcgt

SEQ ID NO: 10860 - DNA, 68 bp, Homo sapiens; identical to SEQ ID NO: 3751
  chr11:44341966-44342034
  hyper

SEQ ID NO: 10861 - DNA, 194 bp, Homo sapiens; identical to SEQ ID NO: 3752
  chr11:45376858-45377052
  hyper

SEQ ID NO: 10862 - DNA, 88 bp, Homo sapiens
  chr11:46259327-46259415
  hyper
acacgcggcgagtggcggtgcgcgcggggccaaccgcgtggagctgtcgggagggcgataggatgggcgcgcccgggctgcaggcggg

SEQ ID NO: 10863 - DNA, 15 bp, Homo sapiens
  chr11:46316818-46316833
  hyper
gtaccattactgccc

SEQ ID NO: 10864 - DNA, 461 bp, Homo sapiens; identical to SEQ ID NO: 980
  chr11:46316895-46317356
  hyper

SEQ ID NO: 10865 - DNA, 290 bp, Homo sapiens; identical to SEQ ID NO: 981
  chr11:46317407-46317697
  hyper

SEQ ID NO: 10866 - DNA, 137 bp, Homo sapiens
  chr11:46414563-46414700
  hyper
gaatgggagggaactcgagtagaagccagcgctgcggggctcttggtgtggggttctccgcgcggaacccggaagtggagttcgggtccccagagctcgcgagcgcgacggctggggttggtcggaattgggaactt

SEQ ID NO: 10867 - DNA, 577 bp, Homo sapiens; identical to SEQ ID NO: 3756
  chr11:47208680-47209257
  hyper

SEQ ID NO: 10868 - DNA, 64 bp, Homo sapiens
  chr11:47615772-47615836
  hyper
gcaggctgcaggctgcgggtgccgggctgcgcgctgaccgcccgcgctgcggcaggggcggcgg

SEQ ID NO: 10869 - DNA, 300 bp, Homo sapiens; identical to SEQ ID NO: 3757
  chr11:57194178-57194478
  hyper

SEQ ID NO: 10870 - DNA, 30 bp, Homo sapiens
  chr11:58668429-58668459
  hyper
aggttagttctctggcgccatcagctggca

SEQ ID NO: 10871 - DNA, 450 bp, Homo sapiens; identical to SEQ ID NO: 3758
  chr11:58672717-58673167
  hyper

SEQ ID NO: 10872 - DNA, 80 bp, Homo sapiens; identical to SEQ ID NO: 3759
  chr11:58673168-58673248
  hyper

SEQ ID NO: 10873 - DNA, 170 bp, Homo sapiens
  chr11:59333371-59333541
  hyper
agcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacc

SEQ ID NO: 10874 - DNA, 153 bp, Homo sapiens; identical to SEQ ID NO: 982
  chr11:60718701-60718854
  hyper

SEQ ID NO: 10875 - DNA, 145 bp, Homo sapiens; identical to SEQ ID NO: 983
  chr11:60718976-60719121
  hyper

SEQ ID NO: 10876 - DNA, 197 bp, Homo sapiens
  chr11:61062827-61063024
  hyper
gcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 10877 - DNA, 97 bp, Homo sapiens
  chr11:61063061-61063158
  hyper
cgctgagcagttctaggcctgcccccagcctgccagaaggtctgcaccctaacgccggagtgcgttgatctgtgggtccaaccgctccctggcctgg

SEQ ID NO: 10878 - DNA, 38 bp, Homo sapiens
  chr11:61276466-61276504
  hyper
gaccatgggcatcgccgagtccacgccggatgagctgc

SEQ ID NO: 10879 - DNA, 348 bp, Homo sapiens; identical to SEQ ID NO: 3762
  chr11:61276772-61277120
  hyper

SEQ ID NO: 10880 - DNA, 15 bp, Homo sapiens
  chr11:61277327-61277342
  hyper
cgctccaggactggg

SEQ ID NO: 10881 - DNA, 51 bp, Homo sapiens
  chr11:61335193-61335244
  hyper
ctgcaccccggcgggcgcacagacggtccccagcggcggcctgggccagcg

SEQ ID NO: 10882 - DNA, 274 bp, Homo sapiens; identical to SEQ ID NO: 3764
  chr11:61595049-61595323
  hyper

SEQ ID NO: 10883 - DNA, 465 bp, Homo sapiens
  chr11:61596120-61596585
  hyper
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggac

SEQ ID NO: 10884 - DNA, 158 bp, Homo sapiens
  chr11:64059919-64060077
  hyper
aggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccc

SEQ ID NO: 10885 - DNA, 72 bp, Homo sapiens
  chr11:64066962-64067034
  hyper
ggccccgatccccttcgccccccgagaaggctcagccgccttccccgcccacggcctcggccctggattatc

SEQ ID NO: 10886 - DNA, 123 bp, Homo sapiens
  chr11:64409956-64410079
  hyper
agcgccccccgcccccgggccaaccgggtggccggcatctacagtgccacttaccgtggccgccgcgggtgaggaagggcatgcggttgatggcgatgggcacggtgccgtgcttgctgtgga

SEQ ID NO: 10887 - DNA, 59 bp, Homo sapiens
  chr11:64410347-64410406
  hyper
gcccccctccggctccgagctccgggagcggggtagggatgaagcggaggtaaaccagg

SEQ ID NO: 10888 - DNA, 108 bp, Homo sapiens
  chr11:64478789-64478897
  hyper
gaccaggggagagaacgtcaggcctgaggcacacacgagctggaagaacagggacgaggggcggggagagacgcgcatgcgccgcccccagaccgatgggggagcccc

SEQ ID NO: 10889 - DNA, 58 bp, Homo sapiens
  chr11:64480273-64480331
  hyper
cctcgcccggacacgcgtccccgcagccctggagcgctcgcacccactcacaagccct

SEQ ID NO: 10890 - DNA, 821 bp, Homo sapiens
  chr11:64480379-64481200
  hyper
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcc

SEQ ID NO: 10891 - DNA, 328 bp, Homo sapiens
  chr11:64512954-64513282
  hyper
gtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggac

SEQ ID NO: 10892 - DNA, 30 bp, Homo sapiens
  chr11:64739455-64739485
  hyper
gctctctgaaaaaggcgggcgccaacctcg

SEQ ID NO: 10893 - DNA, 32 bp, Homo sapiens
  chr11:64739698-64739730
  hyper
gcccattgtttatttcgcgcctgctttagcgt

SEQ ID NO: 10894 - DNA, 30 bp, Homo sapiens
  chr11:65185213-65185243
  hyper
aggtgcagggcagcccggggaggcagggct

SEQ ID NO: 10895 - DNA, 30 bp, Homo sapiens
  chr11:65185467-65185497
  hyper
gagtgctcaggaggacgggggaccaaggcc

SEQ ID NO: 10896 - DNA, 762 bp, Homo sapiens; identical to SEQ ID NO: 984
  chr11:65600895-65601657
  hyper

SEQ ID NO: 10897 - DNA, 73 bp, Homo sapiens; identical to SEQ ID NO: 985
  chr11:65816447-65816520
  hyper

SEQ ID NO: 10898 - DNA, 4 bp, Homo sapiens
  chr11:65816560-65816564
  hyper
cggg

SEQ ID NO: 10899 - DNA, 75 bp, Homo sapiens; identical to SEQ ID NO: 987
  chr11:66188095-66188170
  hyper

SEQ ID NO: 10900 - DNA, 110 bp, Homo sapiens
  chr11:66188375-66188485
  hyper
cccctccccagtcagcggctcccgctgcagcttgcttagcccagcctcccgctctcccgcccccccggctctaaaacgagccccccacgcctggcaggagctatataagg

SEQ ID NO: 10901 - DNA, 15 bp, Homo sapiens
  chr11:66188769-66188784
  hyper
gcacatcatgagcct

SEQ ID NO: 10902 - DNA, 257 bp, Homo sapiens; identical to SEQ ID NO: 3770
  chr11:66188852-66189109
  hyper

SEQ ID NO: 10903 - DNA, 66 bp, Homo sapiens
  chr11:67479192-67479258
  hyper
ccctctgcgcctgttcgtacgggcagggccggcggccgagtccagcgggctcggggccaggcctgg

SEQ ID NO: 10904 - DNA, 74 bp, Homo sapiens
  chr11:67895805-67895879
  hyper
cccagcgctactgcccgggccgaattccaaggccagcggctgcccgctgagaaggaatccggaccaacgggatt

SEQ ID NO: 10905 - DNA, 30 bp, Homo sapiens
  chr11:69452211-69452241
  hyper
tgcgggggagagggccgaacgtgacctccg

SEQ ID NO: 10906 - DNA, 282 bp, Homo sapiens
  chr11:69517132-69517414
  hyper
ggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacagg

SEQ ID NO: 10907 - DNA, 285 bp, Homo sapiens
  chr11:69518290-69518575
  hyper
aggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggg

SEQ ID NO: 10908 - DNA, 30 bp, Homo sapiens
  chr11:69519421-69519451
  hyper
ttgcaattcctgccccgccccttttatccg

SEQ ID NO: 10909 - DNA, 180 bp, Homo sapiens
  chr11:69588904-69589084
  hyper
gggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctg

SEQ ID NO: 10910 - DNA, 100 bp, Homo sapiens
  chr11:69589407-69589507
  hyper
ccccgagcaggtgcccgccgagggtctcagagtgtgactgagcgggttggcccggcggccgttgccccccgcccccgccccttcgcgcctggccgcgcca

SEQ ID NO: 10911 - DNA, 282 bp, Homo sapiens
  chr11:69589831-69590113
  hyper
ggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 10912 - DNA, 353 bp, Homo sapiens
  chr11:69590114-69590467
  hyper
cccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagcc

SEQ ID NO: 10913 - DNA, 531 bp, Homo sapiens
  chr11:71318279-71318810
  hyper
ggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttc

SEQ ID NO: 10914 - DNA, 66 bp, Homo sapiens
  chr11:71318952-71319018
  hyper
cgctccagatccccccagctctcggcggcggacccgggccgcgtgtgagcgcgctttgcacctcct

SEQ ID NO: 10915 - DNA, 86 bp, Homo sapiens
  chr11:71951583-71951669
  hyper
ggagtgttccagggccgtggagagcagtttagggcgccagtaaaccttttgtctagggcatccagtcaaggcgggccaactgaaca

SEQ ID NO: 10916 - DNA, 30 bp, Homo sapiens
  chr11:71952340-71952370
  hyper
tgtgtgcaggggggccggggggggggcaaa

SEQ ID NO: 10917 - DNA, 30 bp, Homo sapiens
  chr11:71954593-71954623
  hyper
ttgacctgaagggcacgagacagagatttg

SEQ ID NO: 10918 - DNA, 165 bp, Homo sapiens; identical to SEQ ID NO: 3771
  chr11:71955215-71955380
  hyper

SEQ ID NO: 10919 - DNA, 134 bp, Homo sapiens
  chr11:71956243-71956377
  hyper
ggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 10920 - DNA, 236 bp, Homo sapiens
  chr11:72432837-72433073
  hyper
agggcctccctcctacgtgcccaacagcaacaacagcaacggcggcacctcgcttaccctcagacgcctgctgggtcttggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggt

SEQ ID NO: 10921 - DNA, 146 bp, Homo sapiens
  chr11:74394454-74394600
  hyper
ggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgt

SEQ ID NO: 10922 - DNA, 30 bp, Homo sapiens
  chr11:74441845-74441875
  hyper
acttacgggctcgagcgtgggagtccaggg

SEQ ID NO: 10923 - DNA, 388 bp, Homo sapiens
  chr11:74442255-74442643
  hyper
aggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccggga

SEQ ID NO: 10924 - DNA, 49 bp, Homo sapiens
  chr11:74442705-74442754
  hyper
cgggccacggggtttaacccctgactccccgcgacgccaagaatgcagg

SEQ ID NO: 10925 - DNA, 33 bp, Homo sapiens
  chr11:74952180-74952213
  hyper
ccagtgctactgcttcggcggccccaagctgct

SEQ ID NO: 10926 - DNA, 5 bp, Homo sapiens
  chr11:74952724-74952729
  hyper
gaccc

SEQ ID NO: 10927 - DNA, 198 bp, Homo sapiens
  chr11:75141367-75141565
  hyper
gcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgc

SEQ ID NO: 10928 - DNA, 553 bp, Homo sapiens
  chr11:75378696-75379249
  hyper
tgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgc

SEQ ID NO: 10929 - DNA, 791 bp, Homo sapiens
  chr11:75379282-75380073
  hyper
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgc

SEQ ID NO: 10930 - DNA, 138 bp, Homo sapiens
  chr11:75863325-75863463
  hyper
ctgacctcagccctgcgggccccgttcccgccattccttcctgcctctcacgttgactgggctccccctgtcggtcggcactggctgaacagccatggagtggcgctttggggaaaccacgggcgaccaggaaagatc

SEQ ID NO: 10931 - DNA, 156 bp, Homo sapiens
  chr11:76032912-76033068
  hyper
gccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccct

SEQ ID NO: 10932 - DNA, 30 bp, Homo sapiens
  chr11:76382193-76382223
  hyper
gcgggggcaaacaggcgaggtgacggcggg

SEQ ID NO: 10933 - DNA, 176 bp, Homo sapiens; identical to SEQ ID NO: 3772
  chr11:78672891-78673067
  hyper

SEQ ID NO: 10934 - DNA, 30 bp, Homo sapiens
  chr11:78673274-78673304
  hyper
ttggctgggccacaccgttgcctagcaacc

SEQ ID NO: 10935 - DNA, 142 bp, Homo sapiens
  chr11:79148873-79149015
  hyper
cttcctggattcccacggctggaccagagcccctctggcagccgggttaaaggctccttcagcaaggtcaaggcgcggccggctggcacctggggatttttttccagccgagcactggcttttcaatcgcattgttaaggat

SEQ ID NO: 10936 - DNA, 30 bp, Homo sapiens
  chr11:79149278-79149308
  hyper
ttatccccctacagacgaaaatcaagattt

SEQ ID NO: 10937 - DNA, 42 bp, Homo sapiens
  chr11:79149528-79149570
  hyper
gtaagggtggcagcccggcagagccagcgttctactccctct

SEQ ID NO: 10938 - DNA, 61 bp, Homo sapiens
  chr11:79150941-79151002
  hyper
gacgaacatcaataccgcggccgggcgcccggtgaggagaggcgggcgccccgcgggttgc

SEQ ID NO: 10939 - DNA, 137 bp, Homo sapiens
  chr11:79152080-79152217
  hyper
cggtagccaatcctacgaggccggcgagccgcgcggcgcactggcgctgggagcagggccgcactccggcgcgggggggcgccacgcaggtgatgggcgcctctccgggggccacgcgcggccgctccctcacccca

SEQ ID NO: 10940 - DNA, 20 bp, Homo sapiens
  chr11:82443549-82443569
  hyper
aaaggctggaataggcggtg

SEQ ID NO: 10941 - DNA, 69 bp, Homo sapiens
  chr11:82443651-82443720
  hyper
cgaaagaggccaaatggccccgcccgtcctccccgccgggagaatccgcagcggcggggtacagggggc

SEQ ID NO: 10942 - DNA, 32 bp, Homo sapiens
  chr11:82444153-82444185
  hyper
tgccacgtcccctcccgcgcccccagtgcccg

SEQ ID NO: 10943 - DNA, 549 bp, Homo sapiens; identical to SEQ ID NO: 3773
  chr11:82444635-82445184
  hyper

SEQ ID NO: 10944 - DNA, 79 bp, Homo sapiens
  chr11:84431621-84431700
  hyper
cccttccctggggaacgaggcgtgtggggggagggacagaaccaagaaagaatttttccccctacggtgaatttggggg

SEQ ID NO: 10945 - DNA, 30 bp, Homo sapiens
  chr11:84432138-84432168
  hyper
accgctacagccacccgagggtagaagacc

SEQ ID NO: 10946 - DNA, 76 bp, Homo sapiens; identical to SEQ ID NO: 3774
  chr11:86085786-86085862
  hyper

SEQ ID NO: 10947 - DNA, 60 bp, Homo sapiens; identical to SEQ ID NO: 3775
  chr11:86085931-86085991
  hyper

SEQ ID NO: 10948 - DNA, 38 bp, Homo sapiens; identical to SEQ ID NO: 988
  chr11:88241938-88241976
  hyper

SEQ ID NO: 10949 - DNA, 145 bp, Homo sapiens; identical to SEQ ID NO: 989
  chr11:88242130-88242275
  hyper

SEQ ID NO: 10950 - DNA, 42 bp, Homo sapiens; identical to SEQ ID NO: 990
  chr11:88242358-88242400
  hyper

SEQ ID NO: 10951 - DNA, 111 bp, Homo sapiens; identical to SEQ ID NO: 3779
  chr11:88798820-88798931
  hyper

SEQ ID NO: 10952 - DNA, 170 bp, Homo sapiens; identical to SEQ ID NO: 3780
  chr11:88798965-88799135
  hyper

SEQ ID NO: 10953 - DNA, 34 bp, Homo sapiens
  chr11:89224559-89224593
  hyper
ggcgccgagccagcccgggcggggtctgctaccc

SEQ ID NO: 10954 - DNA, 517 bp, Homo sapiens
  chr11:91957315-91957832
  hyper
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccg

SEQ ID NO: 10955 - DNA, 120 bp, Homo sapiens; identical to SEQ ID NO: 3781
  chr11:91958730-91958850
  hyper

SEQ ID NO: 10956 - DNA, 30 bp, Homo sapiens
  chr11:91959509-91959539
  hyper
catgattgggctttgcggaaagcaactttt

SEQ ID NO: 10957 - DNA, 32 bp, Homo sapiens
  chr11:91960082-91960114
  hyper
gcccccagactctggcgcgtttgttttccaag

SEQ ID NO: 10958 - DNA, 80 bp, Homo sapiens
  chr11:91960369-91960449
  hyper
ttctcccacttgcctcggacatattaattttctggccccgacgctagtcttttcaaaggcgagtccggggtagtgggagg

SEQ ID NO: 10959 - DNA, 124 bp, Homo sapiens
  chr11:93063613-93063737
  hyper
cagcgaggtcgcgctcgcgcggggtgaggttggaggcagccgaggagccgcacagggcagcgcctgccgccgccgccgcgcccatcccccactccgacggccacgagttcgggccgcgacgtcc

SEQ ID NO: 10960 - DNA, 49 bp, Homo sapiens
  chr11:94134067-94134116
  hyper
caactgccaggttgacgatgaagaggctggtggccgagtgcattcgctg

SEQ ID NO: 10961 - DNA, 118 bp, Homo sapiens
  chr11:94134346-94134464
  hyper
ggccctcgtggggctcggtggctcgcaccaaggggaggagacagagcagcaagaggtgagggaccattttgcaggagccacccctcccctgggagcctgcgggccgggcgtcccctcc

SEQ ID NO: 10962 - DNA, 125 bp, Homo sapiens
  chr11:94134716-94134841
  hyper
ctccccccaccctaccgggtggcgccgttgctgaccccacgcccagccgttcccactcccgcctgaaactcctccgacagggcttcgcttcgggggctcagtccccagcgcgtacacactcgcgt

SEQ ID NO: 10963 - DNA, 75 bp, Homo sapiens; identical to SEQ ID NO: 3782
  chr11:94473596-94473671
  hyper

SEQ ID NO: 10964 - DNA, 97 bp, Homo sapiens; identical to SEQ ID NO: 3783
  chr11:94473672-94473769
  hyper

SEQ ID NO: 10965 - DNA, 96 bp, Homo sapiens; identical to SEQ ID NO: 3784
  chr11:94473802-94473898
  hyper

SEQ ID NO: 10966 - DNA, 30 bp, Homo sapiens
  chr11:94474489-94474519
  hyper
ggcttctgaaacctgcgctcatcttgccgg

SEQ ID NO: 10967 - DNA, 521 bp, Homo sapiens
  chr11:94501445-94501966
  hyper
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttg

SEQ ID NO: 10968 - DNA, 34 bp, Homo sapiens
  chr11:98891367-98891401
  hyper
gttgcagagcagaaacgctcggggaaggggggca

SEQ ID NO: 10969 - DNA, 30 bp, Homo sapiens
  chr11:98891804-98891834
  hyper
gggtcccgtctgctgcgagaggcagggcaa

SEQ ID NO: 10970 - DNA, 708 bp, Homo sapiens; identical to SEQ ID NO: 3785
  chr11:100997686-100998394
  hyper

SEQ ID NO: 10971 - DNA, 30 bp, Homo sapiens
  chr11:100999675-100999705
  hyper
cgaggtctggctccccgggaacggacctgc

SEQ ID NO: 10972 - DNA, 375 bp, Homo sapiens; identical to SEQ ID NO: 3786
  chr11:101453090-101453465
  hyper

SEQ ID NO: 10973 - DNA, 64 bp, Homo sapiens
  chr11:101454510-101454574
  hyper
gggcagagagggcacaggcggggccgctggtggtagcgaagcgtaagagcggagagcaagggag

SEQ ID NO: 10974 - DNA, 35 bp, Homo sapiens
  chr11:101918471-101918506
  hyper
ggtgggatcggttatcggtgcgctctgagagggtg

SEQ ID NO: 10975 - DNA, 345 bp, Homo sapiens; identical to SEQ ID NO: 3787
  chr11:104034409-104034754
  hyper

SEQ ID NO: 10976 - DNA, 463 bp, Homo sapiens; identical to SEQ ID NO: 3788
  chr11:104034755-104035218
  hyper

SEQ ID NO: 10977 - DNA, 312 bp, Homo sapiens
  chr11:105481005-105481317
  hyper
aaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggcc

SEQ ID NO: 10978 - DNA, 1 bp, Homo sapiens
  chr11:105481318-105481319
  hyper
c

SEQ ID NO: 10979 - DNA, 2 bp, Homo sapiens
  chr11:105481320-105481322
  hyper
gc

SEQ ID NO: 10980 - DNA, 207 bp, Homo sapiens
  chr11:105481323-105481530
  hyper
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaag

SEQ ID NO: 10981 - DNA, 203 bp, Homo sapiens
  chr11:106888283-106888486
  hyper
tgtagtcccctcttccgccctagcctaggggatcctctgtcgccggagccactggaaccctaggccgtgcagggtaaggccgggccgccccccagcggtcgggctctgcgctcgcgccccggctcgcccagcgccaactttacagatccgcgttctctcccccgaaggcggtccccccttccgccccccgctcaccgagggcg

SEQ ID NO: 10982 - DNA, 127 bp, Homo sapiens
  chr11:106888697-106888824
  hyper
ctccccctcctcctccgggctggtctccaggtagtcggagcccagggagctgaaggactcggacgaaatcttccttcgagacatgctgccggcggagctgcagcggccgaggcggtggcggcgagga

SEQ ID NO: 10983 - DNA, 15 bp, Homo sapiens
  chr11:106889400-106889415
  hyper
cgttgctgtcctctg

SEQ ID NO: 10984 - DNA, 286 bp, Homo sapiens
  chr11:106889690-106889976
  hyper
ccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgt

SEQ ID NO: 10985 - DNA, 323 bp, Homo sapiens
  chr11:107462128-107462451
  hyper
agtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgag

SEQ ID NO: 10986 - DNA, 448 bp, Homo sapiens
  chr11:107799357-107799805
  hyper
tcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttcccc

SEQ ID NO: 10987 - DNA, 15 bp, Homo sapiens
  chr11:109292815-109292830
  hyper
tctggcaataggctg

SEQ ID NO: 10988 - DNA, 284 bp, Homo sapiens
  chr11:109292891-109293175
  hyper
cgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtt

SEQ ID NO: 10989 - DNA, 18 bp, Homo sapiens
  chr11:109293746-109293764
  hyper
agaaaagaggagagccgg

SEQ ID NO: 10990 - DNA, 26 bp, Homo sapiens
  chr11:109293873-109293899
  hyper
cgcggtgccggcgcagaccccatcct

SEQ ID NO: 10991 - DNA, 141 bp, Homo sapiens
  chr11:110581773-110581914
  hyper
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccgg

SEQ ID NO: 10992 - DNA, 283 bp, Homo sapiens
  chr11:110582137-110582420
  hyper
cgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgcc

SEQ ID NO: 10993 - DNA, 114 bp, Homo sapiens
  chr11:110582421-110582535
  hyper
gccctgactttggggctgacaccgccaaagggcagtcagtgctcgcccaggccacttcgggaggcccaggggcacggcgaggggtcggggaaaggcgatcgcccactacagccc

SEQ ID NO: 10994 - DNA, 140 bp, Homo sapiens; identical to SEQ ID NO: 3789
  chr11:110582889-110583029
  hyper

SEQ ID NO: 10995 - DNA, 853 bp, Homo sapiens; identical to SEQ ID NO: 3790
  chr11:110583043-110583896
  hyper

SEQ ID NO: 10996 - DNA, 30 bp, Homo sapiens
  chr11:110584122-110584152
  hyper
ctagagaagcagtggcggattagtgaggaa

SEQ ID NO: 10997 - DNA, 383 bp, Homo sapiens; identical to SEQ ID NO: 3791
  chr11:111383132-111383515
  hyper

SEQ ID NO: 10998 - DNA, 16 bp, Homo sapiens
  chr11:111383516-111383532
  hyper
ggggtcccgctgggcc

SEQ ID NO: 10999 - DNA, 348 bp, Homo sapiens; identical to SEQ ID NO: 3793
  chr11:111383557-111383905
  hyper

SEQ ID NO: 11000 - DNA, 286 bp, Homo sapiens; identical to SEQ ID NO: 991
  chr11:111411296-111411582
  hyper

SEQ ID NO: 11001 - DNA, 391 bp, Homo sapiens; identical to SEQ ID NO: 992
  chr11:111411821-111412212
  hyper

SEQ ID NO: 11002 - DNA, 320 bp, Homo sapiens
  chr11:113345418-113345738
  hyper
ggggaagtgccctcccgagattgtggggagcggcctccctcccgccctccgatgccgcggctccgccgtgctgccctgggcgccccgcggggaggctgccccagctgcgcccgctcgtgctcggggagaggattcccttctaagtggcgaggaggctactgagaaggagggagaggggatagcagccgcgggctccagacgccctctgcccccgcccgacggggagcccatgcagagccggatcccaggcgggcgctcccgagcaggcggccaggagtggccgcacaaacttctggtcctggcctcgctccccttggagg

SEQ ID NO: 11003 - DNA, 58 bp, Homo sapiens
  chr11:113346283-113346341
  hyper
tcccttgttttgaggcgggaacgcaaccctcgaccgcccactgcgctcccacccacac

SEQ ID NO: 11004 - DNA, 120 bp, Homo sapiens
  chr11:113929618-113929738
  hyper
ttggcctccagcaatcgcgacagctaaaaacgggtgtctcgcttcgacaatagatccccgcggaccttctggcacctggttcactagcgcccgcgaactctgcctcgggagacttattga

SEQ ID NO: 11005 - DNA, 352 bp, Homo sapiens
  chr11:113930374-113930726
  hyper
ggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgcc

SEQ ID NO: 11006 - DNA, 46 bp, Homo sapiens
  chr11:113931651-113931697
  hyper
tttgtgcttccccttcgccgcggggcgggtccgcctcccctgccgc

SEQ ID NO: 11007 - DNA, 510 bp, Homo sapiens
  chr11:115373899-115374409
  hyper
gctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttgggga

SEQ ID NO: 11008 - DNA, 38 bp, Homo sapiens; identical to SEQ ID NO: 993
  chr11:115530058-115530096
  hyper

SEQ ID NO: 11009 - DNA, 201 bp, Homo sapiens; identical to SEQ ID NO: 994
  chr11:115530221-115530422
  hyper

SEQ ID NO: 11010 - DNA, 50 bp, Homo sapiens; identical to SEQ ID NO: 3798
  chr11:115630424-115630474
  hyper

SEQ ID NO: 11011 - DNA, 99 bp, Homo sapiens; identical to SEQ ID NO: 3799
  chr11:115630530-115630629
  hyper

SEQ ID NO: 11012 - DNA, 259 bp, Homo sapiens; identical to SEQ ID NO: 3800
  chr11:115630630-115630889
  hyper

SEQ ID NO: 11013 - DNA, 94 bp, Homo sapiens; identical to SEQ ID NO: 3801
  chr11:115630890-115630984
  hyper

SEQ ID NO: 11014 - DNA, 57 bp, Homo sapiens; identical to SEQ ID NO: 3802
  chr11:115631307-115631364
  hyper

SEQ ID NO: 11015 - DNA, 36 bp, Homo sapiens
  chr11:116706540-116706576
  hyper
tcttagtgtactcctcgagagcgctcaggaagctga

SEQ ID NO: 11016 - DNA, 30 bp, Homo sapiens
  chr11:117667351-117667381
  hyper
ctaggtcaagagtcacggcctgaggacccc

SEQ ID NO: 11017 - DNA, 40 bp, Homo sapiens
  chr11:117667865-117667905
  hyper
cagcgcgctcccagccgcccgcactcggcgccccgctctc

SEQ ID NO: 11018 - DNA, 40 bp, Homo sapiens
  chr11:118663162-118663202
  hyper
tgaagaaagtaggggcggaggaggccgggccctccactaa

SEQ ID NO: 11019 - DNA, 177 bp, Homo sapiens
  chr11:119210471-119210648
  hyper
gcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgc

SEQ ID NO: 11020 - DNA, 32 bp, Homo sapiens
  chr11:119211201-119211233
  hyper
ctctccccaccccggcgcggcccagtcggtcc

SEQ ID NO: 11021 - DNA, 33 bp, Homo sapiens
  chr11:119293352-119293385
  hyper
cggcactgcggcttccttctcctccggtgcccc

SEQ ID NO: 11022 - DNA, 39 bp, Homo sapiens
  chr11:119293386-119293425
  hyper
cacccagcccgccgcgaggtcacccggcagattccctct

SEQ ID NO: 11023 - DNA, 218 bp, Homo sapiens
  chr11:119293708-119293926
  hyper
cccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggaga

SEQ ID NO: 11024 - DNA, 68 bp, Homo sapiens
  chr11:119612200-119612268
  hyper
gtccctgtccttccccgtgtgggacctgcaaccgccccatagcgcagagtccgggaggctccagccac

SEQ ID NO: 11025 - DNA, 76 bp, Homo sapiens
  chr11:119612323-119612399
  hyper
cgtacttttactggggtacggggagccctgccccacggctgtcagctcgggtcgggcgcgccgggtgcccaggagg

SEQ ID NO: 11026 - DNA, 86 bp, Homo sapiens
  chr11:119613014-119613100
  hyper
ccgcgcctgacactccgcagggcccgggggtgggtgggcaggggtgcgagggggcgtggggctgggcgcgccggcctggggggaaa

SEQ ID NO: 11027 - DNA, 30 bp, Homo sapiens
  chr11:119613389-119613419
  hyper
tgcagtaatgcatcacgggctgagggaggg

SEQ ID NO: 11028 - DNA, 48 bp, Homo sapiens
  chr11:119884295-119884343
  hyper
aagttgtgctgctgccggtgctcggatggaccccggggagcagcagcc

SEQ ID NO: 11029 - DNA, 60 bp, Homo sapiens
  chr11:120110879-120110939
  hyper
cccgggccggagcagcggagcgcgcgacagtggcggcgacggctccggcagcggctcccg

SEQ ID NO: 11030 - DNA, 35 bp, Homo sapiens
  chr11:120382869-120382904
  hyper
ctccagtcttcaccccggtccgtctccctccctcc

SEQ ID NO: 11031 - DNA, 318 bp, Homo sapiens
  chr11:120435559-120435877
  hyper
cgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctct

SEQ ID NO: 11032 - DNA, 92 bp, Homo sapiens
  chr11:121593544-121593636
  hyper
tgaacgcgcacggcccgaccaggcttcccccaagctgctaagatttcatttcacctccgacaggcttcatggggactcgctgttaaaagatc

SEQ ID NO: 11033 - DNA, 588 bp, Homo sapiens; identical to SEQ ID NO: 3803
  chr11:122847170-122847758
  hyper

SEQ ID NO: 11034 - DNA, 190 bp, Homo sapiens
  chr11:122848415-122848605
  hyper
ctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatt

SEQ ID NO: 11035 - DNA, 323 bp, Homo sapiens; identical to SEQ ID NO: 995
  chr11:122849801-122850124
  hyper

SEQ ID NO: 11036 - DNA, 232 bp, Homo sapiens; identical to SEQ ID NO: 996
  chr11:122850148-122850380
  hyper

SEQ ID NO: 11037 - DNA, 308 bp, Homo sapiens; identical to SEQ ID NO: 997
  chr11:122850901-122851209
  hyper

SEQ ID NO: 11038 - DNA, 177 bp, Homo sapiens
  chr11:122852438-122852615
  hyper
gtctccaagcctgctcgaaagccggcaaccaccctccgaggctcgaatctccgctgctctctcccgggcctgggctaccccgggcgctggagaggcaagaagacaagctcctgggtaggttgggtctctgtgttggagaattggcagcttggagaggggggccgggagagccaatga

SEQ ID NO: 11039 - DNA, 114 bp, Homo sapiens
  chr11:122854915-122855029
  hyper
ggccctgctctcaggcggagaagccaggagcgatgaggggcggggcggctcccggcgccctcttttccagccccgctcccgcgctgccgccggagagggactcggggcgcagcc

SEQ ID NO: 11040 - DNA, 18 bp, Homo sapiens
  chr11:122855030-122855048
  hyper
ccccgcctctgccggggc

SEQ ID NO: 11041 - DNA, 200 bp, Homo sapiens
  chr11:123065544-123065744
  hyper
aaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggc

SEQ ID NO: 11042 - DNA, 243 bp, Homo sapiens
  chr11:123172620-123172863
  hyper
cggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 11043 - DNA, 24 bp, Homo sapiens
  chr11:123172915-123172939
  hyper
cgtggttgacgaagccattccctc

SEQ ID NO: 11044 - DNA, 15 bp, Homo sapiens
  chr11:123228701-123228716
  hyper
ctttccataccttcc

SEQ ID NO: 11045 - DNA, 392 bp, Homo sapiens; identical to SEQ ID NO: 999
  chr11:123228788-123229180
  hyper

SEQ ID NO: 11046 - DNA, 226 bp, Homo sapiens; identical to SEQ ID NO: 1000
  chr11:123229181-123229407
  hyper

SEQ ID NO: 11047 - DNA, 15 bp, Homo sapiens
  chr11:123301014-123301029
  hyper
actgcctcttcctcc

SEQ ID NO: 11048 - DNA, 944 bp, Homo sapiens; identical to SEQ ID NO: 1002
  chr11:123301082-123302026
  hyper

SEQ ID NO: 11049 - DNA, 41 bp, Homo sapiens
  chr11:123524936-123524977
  hyper
tcgcctccccaggatcggttgcgttccgactggaatcctcc

SEQ ID NO: 11050 - DNA, 152 bp, Homo sapiens
  chr11:124631577-124631729
  hyper
gcttgtatgtggggtcggggatgagagggggctagagttaagtccttaagctctttagccagtgtctcatctagcggctcagctcatccggctctgctgggtggggggtggggagtggacagggtgaggaatggttccgataactcacccca

SEQ ID NO: 11051 - DNA, 32 bp, Homo sapiens
  chr11:124709117-124709149
  hyper
ctgcaaaccagaagacgcggcctgggaggggc

SEQ ID NO: 11052 - DNA, 126 bp, Homo sapiens
  chr11:124709539-124709665
  hyper
ctgcacgcaggatcccgggctgggcaacggcctagaccgcctctcgccaaacctcccacgccagcgccagtccgacgaacaggagctggtccagcgaacaataaaaggccccggggctggggaggg

SEQ ID NO: 11053 - DNA, 49 bp, Homo sapiens
  chr11:124735054-124735103
  hyper
acagggaaaatctctcgccgcgtccagaacggaacgctgggcttggggt

SEQ ID NO: 11054 - DNA, 487 bp, Homo sapiens
  chr11:124735437-124735924
  hyper
cccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgg

SEQ ID NO: 11055 - DNA, 56 bp, Homo sapiens
  chr11:124736196-124736252
  hyper
ccggcagagctgtggcgggcgggcggagctggcggcgaggtcgttaccgctaatta

SEQ ID NO: 11056 - DNA, 74 bp, Homo sapiens
  chr11:124738461-124738535
  hyper
gatccctctactaaccggcctgtctgtaggcatcttcctttgagacgaggaacgcggaacgtctgccaataagg

SEQ ID NO: 11057 - DNA, 254 bp, Homo sapiens
  chr11:124738755-124739009
  hyper
gctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcct

SEQ ID NO: 11058 - DNA, 204 bp, Homo sapiens
  chr11:124933444-124933648
  hyper
ggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcc

SEQ ID NO: 11059 - DNA, 528 bp, Homo sapiens
  chr11:125035692-125036220
  hyper
agagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttg

SEQ ID NO: 11060 - DNA, 220 bp, Homo sapiens
  chr11:125365065-125365285
  hyper
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacct

SEQ ID NO: 11061 - DNA, 197 bp, Homo sapiens
  chr11:125365752-125365949
  hyper
tgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttacc

SEQ ID NO: 11062 - DNA, 125 bp, Homo sapiens
  chr11:125366167-125366292
  hyper
gcccggctccgctcccgcctccaccccaccccttccccgcgctcgtgcccgggctccgggggcgcgcccgcgctcgggcacccacccaactggcacgcgcgggagctggacgtcatcccctcgtt

SEQ ID NO: 11063 - DNA, 181 bp, Homo sapiens; identical to SEQ ID NO: 1003
  chr11:125773880-125774061
  hyper

SEQ ID NO: 11064 - DNA, 312 bp, Homo sapiens; identical to SEQ ID NO: 1004
  chr11:125774122-125774434
  hyper

SEQ ID NO: 11065 - DNA, 15 bp, Homo sapiens
  chr11:126870486-126870501
  hyper
ctccgccggtcctct

SEQ ID NO: 11066 - DNA, 113 bp, Homo sapiens
  chr11:126870524-126870637
  hyper
cgtccgtgggtccctccgggtggcttcggtctctttgtgcctctgggtatctgcagccagccgacacaaactgcctgttcttagccgcctcgggaagccgggattgtcagcaa

SEQ ID NO: 11067 - DNA, 207 bp, Homo sapiens
  chr11:126873186-126873393
  hyper
cctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagggga

SEQ ID NO: 11068 - DNA, 65 bp, Homo sapiens
  chr11:126873727-126873792
  hyper
ccccacctccgccagcggggcgagccggagctgggtgacccagaccctcgcggaggcgggagcct

SEQ ID NO: 11069 - DNA, 64 bp, Homo sapiens
  chr11:128556994-128557058
  hyper
ctgtttgcatgtgggcgtgtgtatgtggggttgtgtgcgggtatgcgggcgccacgcgcttctc

SEQ ID NO: 11070 - DNA, 330 bp, Homo sapiens; identical to SEQ ID NO: 3814
  chr11:128562856-128563186
  hyper

SEQ ID NO: 11071 - DNA, 37 bp, Homo sapiens; identical to SEQ ID NO: 3815
  chr11:128563336-128563373
  hyper

SEQ ID NO: 11072 - DNA, 167 bp, Homo sapiens; identical to SEQ ID NO: 3816
  chr11:128563669-128563836
  hyper

SEQ ID NO: 11073 - DNA, 500 bp, Homo sapiens; identical to SEQ ID NO: 3817
  chr11:128563896-128564396
  hyper

SEQ ID NO: 11074 - DNA, 189 bp, Homo sapiens; identical to SEQ ID NO: 1005
  chr11:128564685-128564874
  hyper

SEQ ID NO: 11075 - DNA, 2 bp, Homo sapiens
  chr11:128564875-128564877
  hyper
tc

SEQ ID NO: 11076 - DNA, 308 bp, Homo sapiens; identical to SEQ ID NO: 1007
  chr11:128564991-128565299
  hyper

SEQ ID NO: 11077 - DNA, 459 bp, Homo sapiens; identical to SEQ ID NO: 1008
  chr11:129242783-129243242
  hyper

SEQ ID NO: 11078 - DNA, 350 bp, Homo sapiens; identical to SEQ ID NO: 1009
  chr11:129243304-129243654
  hyper

SEQ ID NO: 11079 - DNA, 347 bp, Homo sapiens; identical to SEQ ID NO: 1010
  chr11:129243954-129244301
  hyper

SEQ ID NO: 11080 - DNA, 204 bp, Homo sapiens; identical to SEQ ID NO: 1011
  chr11:129244440-129244644
  hyper

SEQ ID NO: 11081 - DNA, 203 bp, Homo sapiens; identical to SEQ ID NO: 1012
  chr11:131780876-131781079
  hyper

SEQ ID NO: 11082 - DNA, 43 bp, Homo sapiens
  chr11:132813715-132813758
  hyper
ggacgcggcacgagacgcggggacgcgcggacgccacgctcag

SEQ ID NO: 11083 - DNA, 32 bp, Homo sapiens
  chr11:132864177-132864209
  hyper
attaaaaagcccaggcgcgattttctaattaa

SEQ ID NO: 11084 - DNA, 41 bp, Homo sapiens
  chr11:132934044-132934085
  hyper
gagtgaggggtggagcggagcccagccgagggagggaagga

SEQ ID NO: 11085 - DNA, 83 bp, Homo sapiens
  chr11:132934490-132934573
  hyper
gcctgaattcttgtccgggtgggactggcctcggtgaaggatccgggaatgggacttccgggccgggccggaggggaagtgtc

SEQ ID NO: 11086 - DNA, 449 bp, Homo sapiens; identical to SEQ ID NO: 1013
  chr11:132952552-132953001
  hyper

SEQ ID NO: 11087 - DNA, 30 bp, Homo sapiens
  chr11:132953290-132953320
  hyper
tcgggtcgctggctgcggagagggctggcc

SEQ ID NO: 11088 - DNA, 122 bp, Homo sapiens
  chr11:133402168-133402290
  hyper
gagcagggcagttgtcgccgagaagacgacccagtaggcaggatggtacatctcgacgctgcggtgctctcagctgccgggcttgctactgcttctgctgctgctaccgctgctgccttcct

SEQ ID NO: 11089 - DNA, 263 bp, Homo sapiens; identical to SEQ ID NO: 3827
  chr11:133825226-133825489
  hyper

SEQ ID NO: 11090 - DNA, 126 bp, Homo sapiens
  chr11:133826138-133826264
  hyper
gcgcctccctgcaggcgctcctcgcggcgcggggctctagcgtgctgcagcctgcccggagaccgcaaactcccgcagccagagtttcccgcagctctgggaggcggccgccgggcaggaggcgac

SEQ ID NO: 11091 - DNA, 80 bp, Homo sapiens
  chr11:133826978-133827058
  hyper
gctcagccttccgcccgtcgcggcgcgaaggaggcgagcccatttcaaggtgcgttgaagtgtggcgagcacagagccgc

SEQ ID NO: 11092 - DNA, 151 bp, Homo sapiens; identical to SEQ ID NO: 3828
  chr11:133906799-133906950
  hyper

SEQ ID NO: 11093 - DNA, 16 bp, Homo sapiens
  chr11:133938772-133938788
  hyper
agagaacccatgtgcc

SEQ ID NO: 11094 - DNA, 275 bp, Homo sapiens; identical to SEQ ID NO: 3830
  chr11:133938789-133939064
  hyper

SEQ ID NO: 11095 - DNA, 316 bp, Homo sapiens; identical to SEQ ID NO: 3831
  chr11:133939065-133939381
  hyper

SEQ ID NO: 11096 - DNA, 44 bp, Homo sapiens
  chr11:133994700-133994744
  hyper
gcttgtcagcgaaaacgctgtgctgagcccggcagaagtctgcc

SEQ ID NO: 11097 - DNA, 774 bp, Homo sapiens; identical to SEQ ID NO: 1014
  chr11:134145653-134146427
  hyper

SEQ ID NO: 11098 - DNA, 232 bp, Homo sapiens; identical to SEQ ID NO: 1015
  chr11:134146444-134146676
  hyper

SEQ ID NO: 11099 - DNA, 217 bp, Homo sapiens; identical to SEQ ID NO: 1016
  chr11:134146677-134146894
  hyper

SEQ ID NO: 11100 - DNA, 279 bp, Homo sapiens
  chr11:134201829-134202108
  hyper
tgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttct

SEQ ID NO: 11101 - DNA, 97 bp, Homo sapiens
  chr11:134281434-134281531
  hyper
ctcttcccctaatcccggtcgacgagggcaggctgtgccgggttttgtttcgcagcccctcggcagcagcgcctcccagcccgagctcggttctcgg

SEQ ID NO: 11102 - DNA, 52 bp, Homo sapiens
  chr11:134281591-134281643
  hyper
acacacaccccagcgcgcgcccgggaggacatggcgtgggcaccgatgggga

SEQ ID NO: 11103 - DNA, 70 bp, Homo sapiens
  chr11:134282862-134282932
  hyper
ccgcggtgtgttggtcggcgggggacggaggccagtgagtgggcgcgcacttggacgtatgtgggtgcac

SEQ ID NO: 11104 - DNA, 32 bp, Homo sapiens
  chr12:1059315-1059347
  hyper
ggacctggtggttctcgcggcctctcaccacc

SEQ ID NO: 11105 - DNA, 244 bp, Homo sapiens; identical to SEQ ID NO: 3835
  chr12:1639107-1639351
  hyper

SEQ ID NO: 11106 - DNA, 197 bp, Homo sapiens
  chr12:2161529-2161726
  hyper
gatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggc

SEQ ID NO: 11107 - DNA, 285 bp, Homo sapiens; identical to SEQ ID NO: 3836
  chr12:2162554-2162839
  hyper

SEQ ID NO: 11108 - DNA, 400 bp, Homo sapiens; identical to SEQ ID NO: 3837
  chr12:2163110-2163510
  hyper

SEQ ID NO: 11109 - DNA, 39 bp, Homo sapiens
  chr12:2800124-2800163
  hyper
cacccaggagctggccgacgcctgcgacatgaccataga

SEQ ID NO: 11110 - DNA, 112 bp, Homo sapiens
  chr12:2862031-2862143
  hyper
ggcccccagtggcaacggtgagagcagtggcccagaaggccagtaccgggaacgacgatggcgggcacaagggtgggcttgcagcagctgctgctggtgctcccacaggctg

SEQ ID NO: 11111 - DNA, 30 bp, Homo sapiens
  chr12:2862442-2862472
  hyper
gtcacacactcaccacggggagaggccgcg

SEQ ID NO: 11112 - DNA, 53 bp, Homo sapiens
  chr12:3475605-3475658
  hyper
gctttcaaacctccccgcgctccgcagcccccagcccccgccctacccgccct

SEQ ID NO: 11113 - DNA, 61 bp, Homo sapiens; identical to SEQ ID NO: 3838
  chr12:3600168-3600229
  hyper

SEQ ID NO: 11114 - DNA, 115 bp, Homo sapiens; identical to SEQ ID NO: 3839
  chr12:3600230-3600345
  hyper

SEQ ID NO: 11115 - DNA, 15 bp, Homo sapiens
  chr12:3600768-3600783
  hyper
tcaccaaacccttgc

SEQ ID NO: 11116 - DNA, 30 bp, Homo sapiens
  chr12:3601542-3601572
  hyper
cagcaccagggacagcgtccgcccctgcag

SEQ ID NO: 11117 - DNA, 555 bp, Homo sapiens; identical to SEQ ID NO: 3840
  chr12:3602162-3602717
  hyper

SEQ ID NO: 11118 - DNA, 15 bp, Homo sapiens
  chr12:3602864-3602879
  hyper
cgctcccccttctca

SEQ ID NO: 11119 - DNA, 335 bp, Homo sapiens; identical to SEQ ID NO: 1017
  chr12:4274054-4274389
  hyper

SEQ ID NO: 11120 - DNA, 547 bp, Homo sapiens
  chr12:4377981-4378528
  hyper
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgc

SEQ ID NO: 11121 - DNA, 929 bp, Homo sapiens
  chr12:4378806-4379735
  hyper
agagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatca

SEQ ID NO: 11122 - DNA, 288 bp, Homo sapiens
  chr12:4383699-4383987
  hyper
gcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctc

SEQ ID NO: 11123 - DNA, 808 bp, Homo sapiens; identical to SEQ ID NO: 1018
  chr12:5017990-5018798
  hyper

SEQ ID NO: 11124 - DNA, 6 bp, Homo sapiens
  chr12:5018799-5018805
  hyper
cgagcc

SEQ ID NO: 11125 - DNA, 229 bp, Homo sapiens; identical to SEQ ID NO: 1020
  chr12:5018806-5019035
  hyper

SEQ ID NO: 11126 - DNA, 659 bp, Homo sapiens; identical to SEQ ID NO: 1021
  chr12:5019084-5019743
  hyper

SEQ ID NO: 11127 - DNA, 397 bp, Homo sapiens; identical to SEQ ID NO: 1022
  chr12:5019793-5020190
  hyper

SEQ ID NO: 11128 - DNA, 94 bp, Homo sapiens
  chr12:5153193-5153287
  hyper
tccccagagaggggccggccgaccgctggagcggagcctgacgccaggcgcccgcggagcgtgagtagggggcgcgggagccggtcagctgggg

SEQ ID NO: 11129 - DNA, 104 bp, Homo sapiens
  chr12:5153357-5153461
  hyper
cgtcagaggaggcgatgaggcccgggcaggctgcggccaggccacagggggagagctccagtgtcccccgacggctgggctcagcgatgggcccaaggagccgg

SEQ ID NO: 11130 - DNA, 35 bp, Homo sapiens
  chr12:5541088-5541123
  hyper
aaatgaccccttccccgccacgggtcccgaagtga

SEQ ID NO: 11131 - DNA, 146 bp, Homo sapiens
  chr12:5541504-5541650
  hyper
cacggtaaggggaggcggcgggcaccttgggtgggcaggtttggggatgggggtccacgtggggagggattttccagtggactggtgcggggggccccagatccgcatcccgccccacccccatcgcgccgcgctcactcactttc

SEQ ID NO: 11132 - DNA, 712 bp, Homo sapiens; identical to SEQ ID NO: 3848
  chr12:5542090-5542802
  hyper

SEQ ID NO: 11133 - DNA, 153 bp, Homo sapiens; identical to SEQ ID NO: 3849
  chr12:6664370-6664523
  hyper

SEQ ID NO: 11134 - DNA, 32 bp, Homo sapiens
  chr12:8123148-8123180
  hyper
tctccctttcttgcactcgtctttatcttcta

SEQ ID NO: 11135 - DNA, 424 bp, Homo sapiens; identical to SEQ ID NO: 3850
  chr12:8171321-8171745
  hyper

SEQ ID NO: 11136 - DNA, 57 bp, Homo sapiens
  chr12:10306356-10306413
  hyper
cccagccagcacatccgccatcctgcaccccaggttccggcacgggctgcgacgggg

SEQ ID NO: 11137 - DNA, 48 bp, Homo sapiens
  chr12:11653509-11653557
  hyper
cgacgagctggagcggcggctgaacgagctgagcgcctagaatcgcag

SEQ ID NO: 11138 - DNA, 30 bp, Homo sapiens
  chr12:11653758-11653788
  hyper
gctcctggcgcaacccgagccagaccctgg

SEQ ID NO: 11139 - DNA, 30 bp, Homo sapiens
  chr12:12869188-12869218
  hyper
tctggagtttgaccccgaggggagtatttt

SEQ ID NO: 11140 - DNA, 49 bp, Homo sapiens
  chr12:13154617-13154666
  hyper
cctgggacgcaaccccgggcaatgcctccggccgcggggagcaaatcaa

SEQ ID NO: 11141 - DNA, 68 bp, Homo sapiens; identical to SEQ ID NO: 1023
  chr12:14133813-14133881
  hyper

SEQ ID NO: 11142 - DNA, 50 bp, Homo sapiens
  chr12:14134167-14134217
  hyper
acctcatgccagattcgttcacgatttcacggcttcgaccctttatctgc

SEQ ID NO: 11143 - DNA, 777 bp, Homo sapiens; identical to SEQ ID NO: 3852
  chr12:14134478-14135255
  hyper

SEQ ID NO: 11144 - DNA, 218 bp, Homo sapiens
  chr12:15374309-15374527
  hyper
ctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 11145 - DNA, 30 bp, Homo sapiens
  chr12:16500494-16500524
  hyper
gggtcgggctttaaacgtgggagggctaat

SEQ ID NO: 11146 - DNA, 107 bp, Homo sapiens
  chr12:16757928-16758035
  hyper
gtgcgcagcctacaccgccgaggaccgactattgtgaagccactttgggagcgggtcggagtggcggcagggggtgggggaagggatgaggacggccagacaagaca

SEQ ID NO: 11147 - DNA, 39 bp, Homo sapiens
  chr12:20521231-20521270
  hyper
cttaaagaaagaaagcggaattgtcgatcactccagttg

SEQ ID NO: 11148 - DNA, 45 bp, Homo sapiens
  chr12:20521792-20521837
  hyper
ccccggctcctccagcgtcagcggctcctgcgcgcgggatgcatt

SEQ ID NO: 11149 - DNA, 124 bp, Homo sapiens
  chr12:20522363-20522487
  hyper
acctggtgctgcagccgctccggagctctcggaaactttcctccgcgctgtgcgcgggctccctgtcctttctgctggcgctgctggtgaggctggtccgcggggaggtcggctgtgacctgga

SEQ ID NO: 11150 - DNA, 33 bp, Homo sapiens
  chr12:20522739-20522772
  hyper
ccagattgggctgggcgtcggggaggatcactt

SEQ ID NO: 11151 - DNA, 585 bp, Homo sapiens
  chr12:21680435-21681020
  hyper
gcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 11152 - DNA, 85 bp, Homo sapiens
  chr12:21927273-21927358
  hyper
tttttttttttacaacgaaggaatcaaatatacaaggtgcgggggggaaaaaacccaagacaacagcctgcgggttgcagtaggg

SEQ ID NO: 11153 - DNA, 30 bp, Homo sapiens
  chr12:21927922-21927952
  hyper
cgacccgggggagggcgggacctgcagagc

SEQ ID NO: 11154 - DNA, 71 bp, Homo sapiens; identical to SEQ ID NO: 1024
  chr12:22093889-22093960
  hyper

SEQ ID NO: 11155 - DNA, 308 bp, Homo sapiens; identical to SEQ ID NO: 1025
  chr12:22093961-22094269
  hyper

SEQ ID NO: 11156 - DNA, 471 bp, Homo sapiens; identical to SEQ ID NO: 1026
  chr12:22094577-22095048
  hyper

SEQ ID NO: 11157 - DNA, 83 bp, Homo sapiens; identical to SEQ ID NO: 1027
  chr12:22486799-22486882
  hyper

SEQ ID NO: 11158 - DNA, 300 bp, Homo sapiens; identical to SEQ ID NO: 1028
  chr12:22487133-22487433
  hyper

SEQ ID NO: 11159 - DNA, 575 bp, Homo sapiens
  chr12:22487691-22488266
  hyper
ccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgc

SEQ ID NO: 11160 - DNA, 322 bp, Homo sapiens
  chr12:22488339-22488661
  hyper
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagc

SEQ ID NO: 11161 - DNA, 92 bp, Homo sapiens
  chr12:24714812-24714904
  hyper
gccttggacattggccgcgatgcccagcacagcccagggttctccccgcactctcctctcgcatcaaccacctccaccgccaccacttacaa

SEQ ID NO: 11162 - DNA, 30 bp, Homo sapiens
  chr12:24715353-24715383
  hyper
tgggttttggtggctcgcctttttcactct

SEQ ID NO: 11163 - DNA, 172 bp, Homo sapiens
  chr12:24716032-24716204
  hyper
ttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggc

SEQ ID NO: 11164 - DNA, 212 bp, Homo sapiens
  chr12:24716205-24716417
  hyper
cggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 11165 - DNA, 194 bp, Homo sapiens; identical to SEQ ID NO: 3858
  chr12:25056242-25056436
  hyper

SEQ ID NO: 11166 - DNA, 601 bp, Homo sapiens; identical to SEQ ID NO: 3859
  chr12:25101397-25101998
  hyper

SEQ ID NO: 11167 - DNA, 77 bp, Homo sapiens; identical to SEQ ID NO: 3860
  chr12:25102009-25102086
  hyper

SEQ ID NO: 11168 - DNA, 219 bp, Homo sapiens
  chr12:28122168-28122387
  hyper
cccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcagga

SEQ ID NO: 11169 - DNA, 392 bp, Homo sapiens
  chr12:28127822-28128214
  hyper
attaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgag

SEQ ID NO: 11170 - DNA, 372 bp, Homo sapiens; identical to SEQ ID NO: 3861
  chr12:28128699-28129071
  hyper

SEQ ID NO: 11171 - DNA, 236 bp, Homo sapiens
  chr12:29937107-29937343
  hyper
ctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 11172 - DNA, 58 bp, Homo sapiens
  chr12:29937344-29937402
  hyper
ctcgcgtccagtcgccggctctgtgctctcctgcccgggctttctctcacccgcccgg

SEQ ID NO: 11173 - DNA, 23 bp, Homo sapiens
  chr12:30322902-30322925
  hyper
cccagcagagcgaggcgctgggc

SEQ ID NO: 11174 - DNA, 426 bp, Homo sapiens; identical to SEQ ID NO: 3863
  chr12:30323014-30323440
  hyper

SEQ ID NO: 11175 - DNA, 24 bp, Homo sapiens
  chr12:30323502-30323526
  hyper
cgccagcttcgtgatcttctgccc

SEQ ID NO: 11176 - DNA, 533 bp, Homo sapiens; identical to SEQ ID NO: 3865
  chr12:30975388-30975921
  hyper

SEQ ID NO: 11177 - DNA, 100 bp, Homo sapiens; identical to SEQ ID NO: 3866
  chr12:31079268-31079368
  hyper

SEQ ID NO: 11178 - DNA, 247 bp, Homo sapiens; identical to SEQ ID NO: 3867
  chr12:31079417-31079664
  hyper

SEQ ID NO: 11179 - DNA, 117 bp, Homo sapiens; identical to SEQ ID NO: 3868
  chr12:31079693-31079810
  hyper

SEQ ID NO: 11180 - DNA, 30 bp, Homo sapiens
  chr12:33591774-33591804
  hyper
agccgcgggttacctcggaggccaaggcag

SEQ ID NO: 11181 - DNA, 28 bp, Homo sapiens
  chr12:33592057-33592085
  hyper
cggcgccgggaggcgggaagcggaccag

SEQ ID NO: 11182 - DNA, 29 bp, Homo sapiens
  chr12:33592613-33592642
  hyper
acgttggccccatggcgggagcggagggc

SEQ ID NO: 11183 - DNA, 13 bp, Homo sapiens
  chr12:33592643-33592656
  hyper
taggggaaggaga

SEQ ID NO: 11184 - DNA, 73 bp, Homo sapiens
  chr12:33592961-33593034
  hyper
gggagggagggagggcgggcggcccggcgcccctgccgaggccggggatgctcatcgttgcccagagttggcc

SEQ ID NO: 11185 - DNA, 40 bp, Homo sapiens
  chr12:33593092-33593132
  hyper
cgcctttgtctctccaacttttccacggatgtattctact

SEQ ID NO: 11186 - DNA, 30 bp, Homo sapiens
  chr12:39298600-39298630
  hyper
actcagatgtgggcccgaaaacaaatcaaa

SEQ ID NO: 11187 - DNA, 167 bp, Homo sapiens
  chr12:39299475-39299642
  hyper
agggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctg

SEQ ID NO: 11188 - DNA, 30 bp, Homo sapiens
  chr12:39300375-39300405
  hyper
agaactgagacctgacggataaaagcagag

SEQ ID NO: 11189 - DNA, 41 bp, Homo sapiens
  chr12:40618628-40618669
  hyper
gagttctgcgcggcccgtcgcctcggcggagcctctggcag

SEQ ID NO: 11190 - DNA, 30 bp, Homo sapiens
  chr12:41086182-41086212
  hyper
tttccctgtggtccccgccccactttccct

SEQ ID NO: 11191 - DNA, 37 bp, Homo sapiens
  chr12:41086835-41086872
  hyper
tgggcgcctggctagcgcatcccggaaaacctgggag

SEQ ID NO: 11192 - DNA, 337 bp, Homo sapiens
  chr12:41582473-41582810
  hyper
ctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgagg

SEQ ID NO: 11193 - DNA, 241 bp, Homo sapiens
  chr12:41583049-41583290
  hyper
cctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagaca

SEQ ID NO: 11194 - DNA, 443 bp, Homo sapiens
  chr12:42983315-42983758
  hyper
ggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctggga

SEQ ID NO: 11195 - DNA, 15 bp, Homo sapiens
  chr12:43945109-43945124
  hyper
cgttcctcattgtcc

SEQ ID NO: 11196 - DNA, 117 bp, Homo sapiens
  chr12:43945664-43945781
  hyper
cctggtgatgaagagcgagagatggtagagcagcccagtcagccacttggccacccacatggttccaccctggggaccccgatcggggaggcccaccagagccgccggcagccaagc

SEQ ID NO: 11197 - DNA, 217 bp, Homo sapiens
  chr12:43946202-43946419
  hyper
cgacttgctgagtagccccaaggcccggctgggcaccaattccggacctatgaaaccgagcgagatgcaagcacccgcgtacgtgaaaggtgcctagggttttgagctcttagatgaaatgacaagcatcagatagaacgtttctgttttttatgttttacggtacttttaggcttctcaaacaaaataaaataagctacaacggaagttcttgtag

SEQ ID NO: 11198 - DNA, 101 bp, Homo sapiens
  chr12:45269011-45269112
  hyper
aaagagaaaggctttcgtcccattatgcagccccgggacctgacgcactccggtcgtggactccccaagttctaactctgttaagacgtcaatctgtaggg

SEQ ID NO: 11199 - DNA, 162 bp, Homo sapiens
  chr12:45269494-45269656
  hyper
gacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtg

SEQ ID NO: 11200 - DNA, 35 bp, Homo sapiens
  chr12:45270707-45270742
  hyper
gctggagagcttccccggcgcggagagcttcccgg

SEQ ID NO: 11201 - DNA, 30 bp, Homo sapiens
  chr12:45444296-45444326
  hyper
agctggctcacctggcgctgaaggctggaa

SEQ ID NO: 11202 - DNA, 140 bp, Homo sapiens
  chr12:45444542-45444682
  hyper
cggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 11203 - DNA, 112 bp, Homo sapiens
  chr12:45444714-45444826
  hyper
cggcgccaaccggtctgctgcgcgcccgccttgcgcccgcctgtcgcccgggcgccccgcaccgcacccagagccgcagcttctcgccgccgcctcccgcagggctggagcg

SEQ ID NO: 11204 - DNA, 237 bp, Homo sapiens
  chr12:45445162-45445399
  hyper
gtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 11205 - DNA, 96 bp, Homo sapiens; identical to SEQ ID NO: 3869
  chr12:47225381-47225477
  hyper

SEQ ID NO: 11206 - DNA, 65 bp, Homo sapiens; identical to SEQ ID NO: 3870
  chr12:47225550-47225615
  hyper

SEQ ID NO: 11207 - DNA, 51 bp, Homo sapiens
  chr12:48396843-48396894
  hyper
ggctggaatcccagccgtcggaaacgtgcccaaacacgtggaaaaaaaaat

SEQ ID NO: 11208 - DNA, 1227 bp, Homo sapiens; identical to SEQ ID NO: 1029
  chr12:48397123-48398350
  hyper

SEQ ID NO: 11209 - DNA, 374 bp, Homo sapiens
  chr12:48577898-48578272
  hyper
ccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgc

SEQ ID NO: 11210 - DNA, 113 bp, Homo sapiens; identical to SEQ ID NO: 3872
  chr12:49297802-49297915
  hyper

SEQ ID NO: 11211 - DNA, 44 bp, Homo sapiens
  chr12:49366387-49366431
  hyper
agcgaacgggttaggcgccaccgtgctcccgcctgactcaccct

SEQ ID NO: 11212 - DNA, 275 bp, Homo sapiens
  chr12:49374100-49374375
  hyper
ctcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgactt

SEQ ID NO: 11213 - DNA, 90 bp, Homo sapiens; identical to SEQ ID NO: 1030
  chr12:49374937-49375027
  hyper

SEQ ID NO: 11214 - DNA, 57 bp, Homo sapiens; identical to SEQ ID NO: 1031
  chr12:49375115-49375172
  hyper

SEQ ID NO: 11215 - DNA, 111 bp, Homo sapiens
  chr12:49375410-49375521
  hyper
cgagtgtctgtgaggcgctgcgcggactcgcccccaggaacgctctcctcgagccctcccccaaacagactcgctagcactcaagacccggttattcgcccacccgagtac

SEQ ID NO: 11216 - DNA, 255 bp, Homo sapiens; identical to SEQ ID NO: 1032
  chr12:49390850-49391105
  hyper

SEQ ID NO: 11217 - DNA, 788 bp, Homo sapiens; identical to SEQ ID NO: 1033
  chr12:49391146-49391934
  hyper

SEQ ID NO: 11218 - DNA, 239 bp, Homo sapiens
  chr12:49483977-49484216
  hyper
gtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgca

SEQ ID NO: 11219 - DNA, 25 bp, Homo sapiens
  chr12:49727091-49727116
  hyper
cgaaggcggccgggcagccgccgca

SEQ ID NO: 11220 - DNA, 634 bp, Homo sapiens; identical to SEQ ID NO: 1034
  chr12:49729728-49730362
  hyper

SEQ ID NO: 11221 - DNA, 94 bp, Homo sapiens; identical to SEQ ID NO: 1035
  chr12:50297461-50297555
  hyper

SEQ ID NO: 11222 - DNA, 115 bp, Homo sapiens; identical to SEQ ID NO: 1036
  chr12:50297973-50298088
  hyper

SEQ ID NO: 11223 - DNA, 186 bp, Homo sapiens
  chr12:50355598-50355784
  hyper
ggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccg

SEQ ID NO: 11224 - DNA, 53 bp, Homo sapiens
  chr12:50426787-50426840
  hyper
caggcgaactgtcatcgacgatccctggacgcgggcgtcgggggcagggaggc

SEQ ID NO: 11225 - DNA, 51 bp, Homo sapiens
  chr12:50444372-50444423
  hyper
caactcccctttctgcgccagcgccgctgcctctcccgtctgtttgcccct

SEQ ID NO: 11226 - DNA, 41 bp, Homo sapiens
  chr12:52208682-52208723
  hyper
gcgggaaccagggaccgaggactgtgcggggacggggacgt

SEQ ID NO: 11227 - DNA, 146 bp, Homo sapiens
  chr12:52262960-52263106
  hyper
ctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccag

SEQ ID NO: 11228 - DNA, 114 bp, Homo sapiens
  chr12:52301192-52301306
  hyper
tgggcaataaggaaacggtttattaggagggagtggtggagctgggccaggcaggaagacgctggaataagaaacatttttgctccagcccccatcccagtcccgggaggctgc

SEQ ID NO: 11229 - DNA, 198 bp, Homo sapiens; identical to SEQ ID NO: 3880
  chr12:52400709-52400907
  hyper

SEQ ID NO: 11230 - DNA, 508 bp, Homo sapiens; identical to SEQ ID NO: 3881
  chr12:52400908-52401416
  hyper

SEQ ID NO: 11231 - DNA, 14 bp, Homo sapiens
  chr12:52627272-52627286
  hyper
gaggtcaccattaa

SEQ ID NO: 11232 - DNA, 79 bp, Homo sapiens; identical to SEQ ID NO: 1037
  chr12:52652141-52652220
  hyper

SEQ ID NO: 11233 - DNA, 14 bp, Homo sapiens
  chr12:52652599-52652613
  hyper
gagtggaacccctc

SEQ ID NO: 11234 - DNA, 211 bp, Homo sapiens
  chr12:52702362-52702573
  hyper
gtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctct

SEQ ID NO: 11235 - DNA, 386 bp, Homo sapiens
  chr12:53108080-53108466
  hyper
actggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggca

SEQ ID NO: 11236 - DNA, 15 bp, Homo sapiens
  chr12:53359301-53359316
  hyper
tagggagctgctccc

SEQ ID NO: 11237 - DNA, 178 bp, Homo sapiens; identical to SEQ ID NO: 3885
  chr12:53359385-53359563
  hyper

SEQ ID NO: 11238 - DNA, 30 bp, Homo sapiens
  chr12:54089321-54089351
  hyper
cgcctctgcccacaccggcccctgcggcct

SEQ ID NO: 11239 - DNA, 48 bp, Homo sapiens
  chr12:54145906-54145954
  hyper
ctccaaggtcccctccgctcgcccctctctgcccgctgccgccgccgc

SEQ ID NO: 11240 - DNA, 378 bp, Homo sapiens; identical to SEQ ID NO: 1039
  chr12:54321250-54321628
  hyper

SEQ ID NO: 11241 - DNA, 30 bp, Homo sapiens
  chr12:54322140-54322170
  hyper
cccccacgcgccagtcgagcctacgcagct

SEQ ID NO: 11242 - DNA, 236 bp, Homo sapiens
  chr12:54324560-54324796
  hyper
gggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcg

SEQ ID NO: 11243 - DNA, 30 bp, Homo sapiens
  chr12:54329604-54329634
  hyper
cgaaggccggcggggcgcgcccgggtgagc

SEQ ID NO: 11244 - DNA, 461 bp, Homo sapiens
  chr12:54332944-54333405
  hyper
gggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacc

SEQ ID NO: 11245 - DNA, 114 bp, Homo sapiens; identical to SEQ ID NO: 3887
  chr12:54338704-54338818
  hyper

SEQ ID NO: 11246 - DNA, 17 bp, Homo sapiens
  chr12:54338978-54338995
  hyper
ggcgggtcaaagagaag

SEQ ID NO: 11247 - DNA, 178 bp, Homo sapiens
  chr12:54339242-54339420
  hyper
tccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaatt

SEQ ID NO: 11248 - DNA, 150 bp, Homo sapiens
  chr12:54343665-54343815
  hyper
acacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgata

SEQ ID NO: 11249 - DNA, 48 bp, Homo sapiens; identical to SEQ ID NO: 1040
  chr12:54345611-54345659
  hyper

SEQ ID NO: 11250 - DNA, 14 bp, Homo sapiens
  chr12:54345965-54345979
  hyper
ggtgggtctcaggg

SEQ ID NO: 11251 - DNA, 50 bp, Homo sapiens
  chr12:54348934-54348984
  hyper
tctcaaccctcccttcggccgcacgtgcgagctggcgcgcgtggaggacg

SEQ ID NO: 11252 - DNA, 64 bp, Homo sapiens
  chr12:54349272-54349336
  hyper
ccggcagcttggtatcgccgttgaaccccggcggcgggctctcggccagcggtaaggaccccgg

SEQ ID NO: 11253 - DNA, 180 bp, Homo sapiens; identical to SEQ ID NO: 1042
  chr12:54354514-54354694
  hyper

SEQ ID NO: 11254 - DNA, 38 bp, Homo sapiens; identical to SEQ ID NO: 1043
  chr12:54354814-54354852
  hyper

SEQ ID NO: 11255 - DNA, 19 bp, Homo sapiens
  chr12:54359664-54359683
  hyper
ttgctctccctcgcccggg

SEQ ID NO: 11256 - DNA, 78 bp, Homo sapiens
  chr12:54359960-54360038
  hyper
tctggctccgctccccgccagctggggacccttccctccctccttcctccccctcccttcccccgcctctctttttct

SEQ ID NO: 11257 - DNA, 30 bp, Homo sapiens
  chr12:54366936-54366966
  hyper
gataacgcgtcatctcgccttcccaaattt

SEQ ID NO: 11258 - DNA, 95 bp, Homo sapiens
  chr12:54367200-54367295
  hyper
tctcctatccctactcggcccaagtgcccccggtccgggaggtctcctacggcctggagccatccggcaagtggcaccatcggaacagctactcc

SEQ ID NO: 11259 - DNA, 39 bp, Homo sapiens
  chr12:54367525-54367564
  hyper
cgagcccccctgctccggcaagggcgaggccaaggggga

SEQ ID NO: 11260 - DNA, 94 bp, Homo sapiens
  chr12:54378085-54378179
  hyper
tctcgggtcggggatcgggtgcctctggtctctggcttcctctttcccctaccccgcgtccattcggaacctccttttccgagcagccatgaag

SEQ ID NO: 11261 - DNA, 284 bp, Homo sapiens
  chr12:54379174-54379458
  hyper
gaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttg

SEQ ID NO: 11262 - DNA, 43 bp, Homo sapiens; identical to SEQ ID NO: 1044
  chr12:54379888-54379931
  hyper

SEQ ID NO: 11263 - DNA, 406 bp, Homo sapiens; identical to SEQ ID NO: 1045
  chr12:54379958-54380364
  hyper

SEQ ID NO: 11264 - DNA, 467 bp, Homo sapiens
  chr12:54387842-54388309
  hyper
gtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtgg

SEQ ID NO: 11265 - DNA, 30 bp, Homo sapiens
  chr12:54388653-54388683
  hyper
tccccaggcgggagccgcctgtcctgtatc

SEQ ID NO: 11266 - DNA, 15 bp, Homo sapiens
  chr12:54391399-54391414
  hyper
cgcctccctctctgc

SEQ ID NO: 11267 - DNA, 245 bp, Homo sapiens
  chr12:54393479-54393724
  hyper
ttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaat

SEQ ID NO: 11268 - DNA, 621 bp, Homo sapiens
  chr12:54393798-54394419
  hyper
cgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctg

SEQ ID NO: 11269 - DNA, 195 bp, Homo sapiens
  chr12:54394466-54394661
  hyper
cgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttgggg

SEQ ID NO: 11270 - DNA, 208 bp, Homo sapiens
  chr12:54398888-54399096
  hyper
cgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttccccta

SEQ ID NO: 11271 - DNA, 106 bp, Homo sapiens
  chr12:54399540-54399646
  hyper
gaggactttagggtgcgcgccgcgggcaagccgtcgtgggagcctcggagcgtgcatccgcgttcgcggagatgttccaagcccagaaatgcgcctgaatgggggg

SEQ ID NO: 11272 - DNA, 120 bp, Homo sapiens; identical to SEQ ID NO: 3895
  chr12:54402676-54402796
  hyper

SEQ ID NO: 11273 - DNA, 504 bp, Homo sapiens; identical to SEQ ID NO: 3896
  chr12:54402856-54403360
  hyper

SEQ ID NO: 11274 - DNA, 383 bp, Homo sapiens
  chr12:54408343-54408726
  hyper
agcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagata

SEQ ID NO: 11275 - DNA, 110 bp, Homo sapiens
  chr12:54425031-54425141
  hyper
cggggggcgccgtgagagcaagccccaggcccgcgccaagctggctgttgcgaaacgtagcggaggcggagagcggagggaaagagaagaccgcgggactggagccctgt

SEQ ID NO: 11276 - DNA, 30 bp, Homo sapiens
  chr12:54440926-54440956
  hyper
gcgtcgcgcttcctccgggcttaatccaga

SEQ ID NO: 11277 - DNA, 30 bp, Homo sapiens
  chr12:54447923-54447953
  hyper
aggggcccggcaattcgcgaggccacgggc

SEQ ID NO: 11278 - DNA, 129 bp, Homo sapiens
  chr12:54520065-54520194
  hyper
ctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 11279 - DNA, 129 bp, Homo sapiens
  chr12:54520221-54520350
  hyper
cgtgcccccgagtcctgcttccccggggcctgctctgtatcaggcgcctgcgccttcaagggtacccggcccgcctgccctccccaagagccgagtttgcgctcctcccggaatcgtttgagagaagga

SEQ ID NO: 11280 - DNA, 250 bp, Homo sapiens
  chr12:54520710-54520960
  hyper
aacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaa

SEQ ID NO: 11281 - DNA, 553 bp, Homo sapiens; identical to SEQ ID NO: 3897
  chr12:54812069-54812622
  hyper

SEQ ID NO: 11282 - DNA, 37 bp, Homo sapiens
  chr12:54943371-54943408
  hyper
aggcggctctggcagcgcgcggcggcggcggcggtag

SEQ ID NO: 11283 - DNA, 14 bp, Homo sapiens
  chr12:57619110-57619124
  hyper
gggcctgtccccca

SEQ ID NO: 11284 - DNA, 37 bp, Homo sapiens
  chr12:57870111-57870148
  hyper
cccgcacccatcctgcgcctctcgctcacactcaccc

SEQ ID NO: 11285 - DNA, 340 bp, Homo sapiens; identical to SEQ ID NO: 3899
  chr12:57943845-57944185
  hyper

SEQ ID NO: 11286 - DNA, 94 bp, Homo sapiens
  chr12:58004814-58004908
  hyper
aagactccccatacacgcaccccgtaccagggggcctctgtccactcggccggggacagccccaaacccagaacatcttcgcacaggccaaggc

SEQ ID NO: 11287 - DNA, 158 bp, Homo sapiens
  chr12:58015011-58015169
  hyper
tctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggt

SEQ ID NO: 11288 - DNA, 166 bp, Homo sapiens; identical to SEQ ID NO: 3900
  chr12:58021293-58021459
  hyper

SEQ ID NO: 11289 - DNA, 88 bp, Homo sapiens; identical to SEQ ID NO: 1046
  chr12:58025646-58025734
  hyper

SEQ ID NO: 11290 - DNA, 156 bp, Homo sapiens
  chr12:58026100-58026256
  hyper
ggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggca

SEQ ID NO: 11291 - DNA, 190 bp, Homo sapiens; identical to SEQ ID NO: 1047
  chr12:62584823-62585013
  hyper

SEQ ID NO: 11292 - DNA, 963 bp, Homo sapiens; identical to SEQ ID NO: 1048
  chr12:62585030-62585993
  hyper

SEQ ID NO: 11293 - DNA, 30 bp, Homo sapiens
  chr12:62829269-62829299
  hyper
accagacaggaaactcgccctgggtctctc

SEQ ID NO: 11294 - DNA, 462 bp, Homo sapiens; identical to SEQ ID NO: 3904
  chr12:63543848-63544310
  hyper

SEQ ID NO: 11295 - DNA, 88 bp, Homo sapiens; identical to SEQ ID NO: 1049
  chr12:63544512-63544600
  hyper

SEQ ID NO: 11296 - DNA, 146 bp, Homo sapiens; identical to SEQ ID NO: 1050
  chr12:63544728-63544874
  hyper

SEQ ID NO: 11297 - DNA, 30 bp, Homo sapiens
  chr12:63545313-63545343
  hyper
cctgaacctggctctcgacctcacctcctc

SEQ ID NO: 11298 - DNA, 165 bp, Homo sapiens; identical to SEQ ID NO: 3907
  chr12:64061785-64061950
  hyper

SEQ ID NO: 11299 - DNA, 293 bp, Homo sapiens
  chr12:64062205-64062498
  hyper
caggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctcc

SEQ ID NO: 11300 - DNA, 27 bp, Homo sapiens
  chr12:64062499-64062526
  hyper
gtgcgcgcaggccccaagcccacatgc

SEQ ID NO: 11301 - DNA, 624 bp, Homo sapiens
  chr12:64062527-64063151
  hyper
cagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcagggaagccaacggaaccgccggcccgccggcggtgcgcccggcattaggaacgtctctactcccctacgatcgctgaggtatcggacagtcagtgcccgttgccaacgcagagggaacgggccgagactgcgggcaacaagtggcagagccggcgtgagtccggtgggtctgatcccagagcctcaggttgacgccacttccttggcacgggacagcgtttactgaatctt

SEQ ID NO: 11302 - DNA, 55 bp, Homo sapiens
  chr12:64784115-64784170
  hyper
cgcagagccactacccgccggatggacttgggcgggttctcggttaggtagacga

SEQ ID NO: 11303 - DNA, 174 bp, Homo sapiens
  chr12:64784390-64784564
  hyper
agctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaa

SEQ ID NO: 11304 - DNA, 232 bp, Homo sapiens; identical to SEQ ID NO: 1051
  chr12:65218319-65218551
  hyper

SEQ ID NO: 11305 - DNA, 281 bp, Homo sapiens; identical to SEQ ID NO: 1052
  chr12:65218900-65219181
  hyper

SEQ ID NO: 11306 - DNA, 179 bp, Homo sapiens; identical to SEQ ID NO: 1053
  chr12:65219605-65219784
  hyper

SEQ ID NO: 11307 - DNA, 327 bp, Homo sapiens; identical to SEQ ID NO: 3911
  chr12:65220112-65220439
  hyper

SEQ ID NO: 11308 - DNA, 200 bp, Homo sapiens; identical to SEQ ID NO: 3912
  chr12:65514835-65515035
  hyper

SEQ ID NO: 11309 - DNA, 215 bp, Homo sapiens
  chr12:65515260-65515475
  hyper
gaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgta

SEQ ID NO: 11310 - DNA, 151 bp, Homo sapiens
  chr12:66122419-66122570
  hyper
atgtaacaatttgtccgtgttcatataataatctgtcaactctgtgatttgcttattatgtgaattaactccataatcgctctgagattgaattcagtgacaccgtttaactgcttctggtttgggggcttttactcgatatttttaggta

SEQ ID NO: 11311 - DNA, 112 bp, Homo sapiens
  chr12:66122818-66122930
  hyper
cccgaagcaaggggacgtttgcgaggagggagaaatttaaacccccttcgctccgcgccacctgggagcactttggcgccgcagactcaggagccgacgccatctccaggac

SEQ ID NO: 11312 - DNA, 139 bp, Homo sapiens; identical to SEQ ID NO: 3913
  chr12:66123380-66123519
  hyper

SEQ ID NO: 11313 - DNA, 48 bp, Homo sapiens
  chr12:66135151-66135199
  hyper
tctctggcccagctgcggagggggaaaggtgatcgatcttgctggggg

SEQ ID NO: 11314 - DNA, 117 bp, Homo sapiens
  chr12:66135452-66135569
  hyper
ccccaatctccctagcgctgtgggggtggctgcagctccccgcgcgctccctcctttgggggggtttctgggctcgtgacttttttttaaataaagaatgagcggatgcccgtgaca

SEQ ID NO: 11315 - DNA, 98 bp, Homo sapiens
  chr12:66135998-66136096
  hyper
ccgccagttctccctcggtcgcgccggcgcacgctcgtccccttctgccccggagcccgcccgcgccgcacggtggccccttgcgctggcctgatcgt

SEQ ID NO: 11316 - DNA, 72 bp, Homo sapiens
  chr12:66217530-66217602
  hyper
gcgcatgaatgcccccgtgtccacgtgtatctgcgtgcatgtgcttacacgcgtgttcgtgtgtatctgcat

SEQ ID NO: 11317 - DNA, 30 bp, Homo sapiens
  chr12:66219066-66219096
  hyper
agggcgcggggcagccgtccacttcagccc

SEQ ID NO: 11318 - DNA, 221 bp, Homo sapiens
  chr12:66582827-66583048
  hyper
ggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 11319 - DNA, 207 bp, Homo sapiens
  chr12:66583049-66583256
  hyper
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcg

SEQ ID NO: 11320 - DNA, 30 bp, Homo sapiens
  chr12:68759101-68759131
  hyper
caccacctaacacatcggggctggtgcagc

SEQ ID NO: 11321 - DNA, 61 bp, Homo sapiens
  chr12:69326653-69326714
  hyper
acacatgagggcaggcgggggcatcaccagctacgtctcggtactccggtctcagggtctc

SEQ ID NO: 11322 - DNA, 350 bp, Homo sapiens
  chr12:69327082-69327432
  hyper
cgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcggga

SEQ ID NO: 11323 - DNA, 176 bp, Homo sapiens
  chr12:71314436-71314612
  hyper
gcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatc

SEQ ID NO: 11324 - DNA, 63 bp, Homo sapiens
  chr12:71314613-71314676
  hyper
ctggggtggtggttgggggtgggggtgggggtggggaagggggaagtgcgggggagacacttg

SEQ ID NO: 11325 - DNA, 30 bp, Homo sapiens
  chr12:72332641-72332671
  hyper
cagggttctggacagcgccccaagcaggca

SEQ ID NO: 11326 - DNA, 34 bp, Homo sapiens
  chr12:72665392-72665426
  hyper
cctttcctgcctcctcgcgcgctccctctccttt

SEQ ID NO: 11327 - DNA, 122 bp, Homo sapiens; identical to SEQ ID NO: 3914
  chr12:72666686-72666808
  hyper

SEQ ID NO: 11328 - DNA, 389 bp, Homo sapiens; identical to SEQ ID NO: 3915
  chr12:72666997-72667386
  hyper

SEQ ID NO: 11329 - DNA, 38 bp, Homo sapiens; identical to SEQ ID NO: 3916
  chr12:72667387-72667425
  hyper

SEQ ID NO: 11330 - DNA, 30 bp, Homo sapiens
  chr12:75601190-75601220
  hyper
gcccagcctcttggccgccaggtcctcgtc

SEQ ID NO: 11331 - DNA, 20 bp, Homo sapiens
  chr12:75601480-75601500
  hyper
ggtcgctggccctgccgccg

SEQ ID NO: 11332 - DNA, 247 bp, Homo sapiens; identical to SEQ ID NO: 1055
  chr12:75601695-75601942
  hyper

SEQ ID NO: 11333 - DNA, 274 bp, Homo sapiens
  chr12:75603075-75603349
  hyper
tgagccgcccttctccgacgagaaactacttgttggcgttttccggattcaggtggttgagccgcttccctgggcgctggggtgggggagaaagcccccgccggccgccggccgcgctccccgccttcattctgtgatctgcggatttgccagtcgccaacctccgcgcccagagtcaccatcgcgcagggttgggcaaaccatggagctcggggcgggtccagccggcactgcccgacccctccgggagcgggcagatcggctggccgtgaat

SEQ ID NO: 11334 - DNA, 92 bp, Homo sapiens
  chr12:75728380-75728472
  hyper
gggctcgagcctgtgcggcaggatggagccaagggagagcgtggtgcgggggcgtggggaaatcgggttgccccagccgttactggtccgcg

SEQ ID NO: 11335 - DNA, 64 bp, Homo sapiens
  chr12:77719516-77719580
  hyper
tccttcccactcccccgcccctcttcgggattctctctttctctttccccgtcctcatttcttt

SEQ ID NO: 11336 - DNA, 271 bp, Homo sapiens
  chr12:79257826-79258097
  hyper
agcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 11337 - DNA, 122 bp, Homo sapiens
  chr12:79258316-79258438
  hyper
tcccaggtccctgtccgctgtggggatggagagacactaacagaactgggatgggcgatgttggctgaacggatccacctattattagtgcgcggggattggctccttggcgcagcgtaccc

SEQ ID NO: 11338 - DNA, 411 bp, Homo sapiens
  chr12:79258439-79258850
  hyper
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactgg

SEQ ID NO: 11339 - DNA, 194 bp, Homo sapiens; identical to SEQ ID NO: 3919
  chr12:81102236-81102430
  hyper

SEQ ID NO: 11340 - DNA, 30 bp, Homo sapiens
  chr12:81330816-81330846
  hyper
tctgccttgccctttcggcagagggcagct

SEQ ID NO: 11341 - DNA, 48 bp, Homo sapiens
  chr12:81331829-81331877
  hyper
aatggtcagaatatacgtgtgtgcatgcgggtgcgtgtgtgtataagg

SEQ ID NO: 11342 - DNA, 90 bp, Homo sapiens
  chr12:81472021-81472111
  hyper
cccgcggggcggtctcgggggccggggatgcagggcactgtcctccggcagtggcagcgagtacaagacccacttcgcagcctcggtgac

SEQ ID NO: 11343 - DNA, 30 bp, Homo sapiens
  chr12:82153211-82153241
  hyper
tgcagtggtttccaccggcccttaaataaa

SEQ ID NO: 11344 - DNA, 191 bp, Homo sapiens
  chr12:85305054-85305245
  hyper
ttcatttctcccatacgtcttaagtagtgaaccgcaaggatggtgcagactaagattgggtctacctataagatctggaggggaaaacggcaagaccagaagaaaccgtcgcagacttatttgcataagcacccaaacactgcttacgtcactgcgccggagtccggaccccgccccgtcttactccagcc

SEQ ID NO: 11345 - DNA, 37 bp, Homo sapiens
  chr12:85305657-85305694
  hyper
cagccacgtgcctttcgtacggcgaaaggcccccttt

SEQ ID NO: 11346 - DNA, 34 bp, Homo sapiens
  chr12:85306519-85306553
  hyper
gccagggaaacagcacgggatacaggcgcgcggg

SEQ ID NO: 11347 - DNA, 8 bp, Homo sapiens
  chr12:85306789-85306797
  hyper
cgagcggc

SEQ ID NO: 11348 - DNA, 28 bp, Homo sapiens
  chr12:85306798-85306826
  hyper
tcttcccagagcccggggctgtgcccgc

SEQ ID NO: 11349 - DNA, 349 bp, Homo sapiens
  chr12:85667272-85667621
  hyper
actcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttg

SEQ ID NO: 11350 - DNA, 108 bp, Homo sapiens
  chr12:85673127-85673235
  hyper
caaagggaagggtggcgaagagggtgtagggaattggttggcattagtataatggcttcattgcctcttgctcggcttctctctcccacccatcgccaccgcgtccac

SEQ ID NO: 11351 - DNA, 375 bp, Homo sapiens; identical to SEQ ID NO: 3920
  chr12:85673460-85673835
  hyper

SEQ ID NO: 11352 - DNA, 345 bp, Homo sapiens
  chr12:85674038-85674383
  hyper
tatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaag

SEQ ID NO: 11353 - DNA, 59 bp, Homo sapiens
  chr12:85674599-85674658
  hyper
tgagtcaagacagaacgcttcctctgcgagcccgccttgcagtccgggcggtaggaact

SEQ ID NO: 11354 - DNA, 224 bp, Homo sapiens; identical to SEQ ID NO: 3921
  chr12:93966429-93966653
  hyper

SEQ ID NO: 11355 - DNA, 149 bp, Homo sapiens; identical to SEQ ID NO: 3922
  chr12:93967067-93967216
  hyper

SEQ ID NO: 11356 - DNA, 544 bp, Homo sapiens
  chr12:94543178-94543722
  hyper
caactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccacc

SEQ ID NO: 11357 - DNA, 272 bp, Homo sapiens
  chr12:95266922-95267194
  hyper
cctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 11358 - DNA, 7 bp, Homo sapiens
  chr12:95267247-95267254
  hyper
cgaagag

SEQ ID NO: 11359 - DNA, 15 bp, Homo sapiens
  chr12:95267666-95267681
  hyper
ccggggcctttctgc

SEQ ID NO: 11360 - DNA, 1 bp, Homo sapiens
  chr12:95267706-95267707
  hyper
c

SEQ ID NO: 11361 - DNA, 14 bp, Homo sapiens
  chr12:95942964-95942978
  hyper
gcgtggcaaactcc

SEQ ID NO: 11362 - DNA, 269 bp, Homo sapiens
  chr12:96883445-96883714
  hyper
ctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctg

SEQ ID NO: 11363 - DNA, 30 bp, Homo sapiens
  chr12:99287423-99287453
  hyper
caattccaaagttcccgtgtctctaatcta

SEQ ID NO: 11364 - DNA, 107 bp, Homo sapiens; identical to SEQ ID NO: 3924
  chr12:99288301-99288408
  hyper

SEQ ID NO: 11365 - DNA, 155 bp, Homo sapiens; identical to SEQ ID NO: 3925
  chr12:99288782-99288937
  hyper

SEQ ID NO: 11366 - DNA, 1 bp, Homo sapiens
  chr12:99288961-99288962
  hyper
c

SEQ ID NO: 11367 - DNA, 93 bp, Homo sapiens; identical to SEQ ID NO: 3927
  chr12:99289161-99289254
  hyper

SEQ ID NO: 11368 - DNA, 136 bp, Homo sapiens
  chr12:101111302-101111438
  hyper
gatggcctccctcaccgcatacggtaactggggccgtcgcgggttcctggggcggcggggcggaagggaggggcccagggagccgtcgaaacacccggggaaacttcggggttcgcctctgcggaggggtctggaa

SEQ ID NO: 11369 - DNA, 30 bp, Homo sapiens
  chr12:103311260-103311290
  hyper
aggtttaggcacttccgggactctcagaag

SEQ ID NO: 11370 - DNA, 60 bp, Homo sapiens
  chr12:103350244-103350304
  hyper
ggccccgccgggctccgctcccagtcgcctgccaccgggccgccgggcacacgcctgggg

SEQ ID NO: 11371 - DNA, 139 bp, Homo sapiens
  chr12:103350383-103350522
  hyper
cgccatcactcaacccccgccccgcatctttcttctccgagggtctgggagtatcccagagcactcccttctttatgatatccgctaagctggtccggaaataatctttatggggagggggtggcggtagggggcgatg

SEQ ID NO: 11372 - DNA, 485 bp, Homo sapiens; identical to SEQ ID NO: 1057
  chr12:103351501-103351986
  hyper

SEQ ID NO: 11373 - DNA, 104 bp, Homo sapiens; identical to SEQ ID NO: 1058
  chr12:103352051-103352155
  hyper

SEQ ID NO: 11374 - DNA, 97 bp, Homo sapiens; identical to SEQ ID NO: 1059
  chr12:103352170-103352267
  hyper

SEQ ID NO: 11375 - DNA, 15 bp, Homo sapiens
  chr12:103352268-103352283
  hyper
cccaagcaagtcaag

SEQ ID NO: 11376 - DNA, 259 bp, Homo sapiens; identical to SEQ ID NO: 1061
  chr12:103352313-103352572
  hyper

SEQ ID NO: 11377 - DNA, 214 bp, Homo sapiens
  chr12:103358685-103358899
  hyper
atggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgc

SEQ ID NO: 11378 - DNA, 177 bp, Homo sapiens
  chr12:103359395-103359572
  hyper
actttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 11379 - DNA, 69 bp, Homo sapiens
  chr12:103359573-103359642
  hyper
cagccagccccaccgcctccggactcgaccccaccatagccccgccgtccgaatcgtctctgaaccaaa

SEQ ID NO: 11380 - DNA, 263 bp, Homo sapiens; identical to SEQ ID NO: 1062
  chr12:103889253-103889516
  hyper

SEQ ID NO: 11381 - DNA, 197 bp, Homo sapiens; identical to SEQ ID NO: 1063
  chr12:103889517-103889714
  hyper

SEQ ID NO: 11382 - DNA, 24 bp, Homo sapiens
  chr12:103889788-103889812
  hyper
cgcagtcgccgggcaaccacaatg

SEQ ID NO: 11383 - DNA, 78 bp, Homo sapiens; identical to SEQ ID NO: 1065
  chr12:104609448-104609526
  hyper

SEQ ID NO: 11384 - DNA, 270 bp, Homo sapiens; identical to SEQ ID NO: 1066
  chr12:104609527-104609797
  hyper

SEQ ID NO: 11385 - DNA, 194 bp, Homo sapiens
  chr12:104851020-104851214
  hyper
ccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtga

SEQ ID NO: 11386 - DNA, 68 bp, Homo sapiens
  chr12:104852083-104852151
  hyper
aggtcctgggctgaccgtccgtttgcatcccccacttctgggatccgagcaacgggaatcccccgggc

SEQ ID NO: 11387 - DNA, 287 bp, Homo sapiens
  chr12:104852152-104852439
  hyper
gcgtgggaatgaaccccattcctccggtcccttgtggctcaggcaaagttccacgtccgaaatctggactgggggagggacgaggctcgtcgcttcctaggggtgcgagggaaagtttgggttctggagagggaggggcgccctcgagcgcggcggccgggggtgagcagctcggctgcgaagcccaacaggtagaacgttccgagaagccttccgggtaacgcgggtctccccgccaagccgtggctcccctgctcccttttaccctcccttagcagccccctgcc

SEQ ID NO: 11388 - DNA, 6 bp, Homo sapiens
  chr12:104852440-104852446
  hyper
ggccac

SEQ ID NO: 11389 - DNA, 61 bp, Homo sapiens
  chr12:104852447-104852508
  hyper
ttggctcagaaatccattttctacgcctccgagttgcctttctcagcgtagtcacagcaat

SEQ ID NO: 11390 - DNA, 60 bp, Homo sapiens
  chr12:104852725-104852785
  hyper
cagattccttgacagcgcagggacagacggcccctttgccccactcggtctggagcagtt

SEQ ID NO: 11391 - DNA, 30 bp, Homo sapiens
  chr12:106974353-106974383
  hyper
cccacctccactctgcgtgcaaaaattata

SEQ ID NO: 11392 - DNA, 41 bp, Homo sapiens
  chr12:106974919-106974960
  hyper
ctgagaccagggtgacgcaaaggtgtcggccggttaggcac

SEQ ID NO: 11393 - DNA, 38 bp, Homo sapiens
  chr12:106975290-106975328
  hyper
ggggagggggcggaccgagggggcggggggcgtctttc

SEQ ID NO: 11394 - DNA, 39 bp, Homo sapiens
  chr12:106975543-106975582
  hyper
cactttatcggggcccgcaggagacgcagcttgctcccc

SEQ ID NO: 11395 - DNA, 50 bp, Homo sapiens
  chr12:106976472-106976522
  hyper
agccaattttgatttcgcctataatgagtgccgggcgaaggctggagaag

SEQ ID NO: 11396 - DNA, 11 bp, Homo sapiens
  chr12:106976842-106976853
  hyper
cgctttttctc

SEQ ID NO: 11397 - DNA, 380 bp, Homo sapiens
  chr12:106977375-106977755
  hyper
gcgcgcgaaggagcgcgctttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttt

SEQ ID NO: 11398 - DNA, 30 bp, Homo sapiens
  chr12:106979261-106979291
  hyper
ggtgacatttcactccgacttgcaaaaccg

SEQ ID NO: 11399 - DNA, 89 bp, Homo sapiens
  chr12:106979906-106979995
  hyper
aaagccccagcttgccgcgcgccgcggtgctccggcaggaggcaaaggcgacaggcgcgcgcaggggcagtcgacgcaccttctggccg

SEQ ID NO: 11400 - DNA, 164 bp, Homo sapiens
  chr12:106980293-106980457
  hyper
tcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtg

SEQ ID NO: 11401 - DNA, 628 bp, Homo sapiens; identical to SEQ ID NO: 1067
  chr12:106980911-106981539
  hyper

SEQ ID NO: 11402 - DNA, 298 bp, Homo sapiens
  chr12:107714866-107715164
  hyper
aggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaag

SEQ ID NO: 11403 - DNA, 492 bp, Homo sapiens; identical to SEQ ID NO: 1068
  chr12:108168922-108169414
  hyper

SEQ ID NO: 11404 - DNA, 34 bp, Homo sapiens; identical to SEQ ID NO: 1069
  chr12:108169549-108169583
  hyper

SEQ ID NO: 11405 - DNA, 255 bp, Homo sapiens; identical to SEQ ID NO: 3941
  chr12:108238259-108238514
  hyper

SEQ ID NO: 11406 - DNA, 345 bp, Homo sapiens
  chr12:108297411-108297756
  hyper
tgattcctagaaactcgcagggcggcacagcacggcggctcgtggcagcagaagaggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 11407 - DNA, 43 bp, Homo sapiens
  chr12:110271088-110271131
  hyper
agatgtccccaggggcgcgaggggacctcggctgagccgcccc

SEQ ID NO: 11408 - DNA, 30 bp, Homo sapiens
  chr12:111127300-111127330
  hyper
cccgccaacccctttcggggagcttctgct

SEQ ID NO: 11409 - DNA, 372 bp, Homo sapiens
  chr12:111284662-111285034
  hyper
cttgtcctctcctcccgagggccctgtgccctcccagcggacttgcaggggagaacgtccatgtttgtgcgagtcacaaaggcgcccgttccaggggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactggtaagtttcgccgcccgcccggccgcgcctgctgcgccacagctccccctgccagggaaaaggaaagagcggtcgcggtccccagtccattcatatctcgctgccctaagcgttgaaagtatcag

SEQ ID NO: 11410 - DNA, 553 bp, Homo sapiens; identical to SEQ ID NO: 3942
  chr12:111471407-111471960
  hyper

SEQ ID NO: 11411 - DNA, 138 bp, Homo sapiens; identical to SEQ ID NO: 3943
  chr12:111472058-111472196
  hyper

SEQ ID NO: 11412 - DNA, 161 bp, Homo sapiens; identical to SEQ ID NO: 3944
  chr12:111472356-111472517
  hyper

SEQ ID NO: 11413 - DNA, 95 bp, Homo sapiens; identical to SEQ ID NO: 3945
  chr12:111472577-111472672
  hyper

SEQ ID NO: 11414 - DNA, 166 bp, Homo sapiens; identical to SEQ ID NO: 3946
  chr12:111472851-111473017
  hyper

SEQ ID NO: 11415 - DNA, 325 bp, Homo sapiens; identical to SEQ ID NO: 1070
  chr12:113012954-113013279
  hyper

SEQ ID NO: 11416 - DNA, 502 bp, Homo sapiens
  chr12:113494535-113495037
  hyper
cccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggc

SEQ ID NO: 11417 - DNA, 13 bp, Homo sapiens
  chr12:113495038-113495051
  hyper
ccccccaggcgga

SEQ ID NO: 11418 - DNA, 79 bp, Homo sapiens; identical to SEQ ID NO: 1071
  chr12:113541522-113541601
  hyper

SEQ ID NO: 11419 - DNA, 438 bp, Homo sapiens; identical to SEQ ID NO: 1072
  chr12:113541661-113542099
  hyper

SEQ ID NO: 11420 - DNA, 271 bp, Homo sapiens
  chr12:113592127-113592398
  hyper
tccaataataaggaacgctggcggccaggtgggatggagagggtaaggcactgcaggcccatgtgagtcccttccccgcccccgactctagttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctg

SEQ ID NO: 11421 - DNA, 401 bp, Homo sapiens; identical to SEQ ID NO: 1073
  chr12:113900758-113901159
  hyper

SEQ ID NO: 11422 - DNA, 24 bp, Homo sapiens
  chr12:113901407-113901431
  hyper
cgaagtaggcgggggacccgggac

SEQ ID NO: 11423 - DNA, 124 bp, Homo sapiens
  chr12:113902065-113902189
  hyper
gaacctccagagaagcggaggctgacaggcccggggagaggaaccgggcagggacaaaccagcggacagagcagagcgcgaaatggttgagaccgggaagcgacctggccgggggaaactggat

SEQ ID NO: 11424 - DNA, 522 bp, Homo sapiens
  chr12:113903021-113903543
  hyper
taatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccac

SEQ ID NO: 11425 - DNA, 222 bp, Homo sapiens
  chr12:113904807-113905029
  hyper
gcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggt

SEQ ID NO: 11426 - DNA, 66 bp, Homo sapiens
  chr12:113905673-113905739
  hyper
aagcaaggcggggggcggaattcagagaggtaaagtgacccgcccccaaatcgcaataccaggagg

SEQ ID NO: 11427 - DNA, 122 bp, Homo sapiens
  chr12:113906312-113906434
  hyper
ggctacggccagccccgctggattccctcccaaacctgcgacagcccctcccccagggacccggtgcccgcccactctctccaggcggggctgggcctttggaggggcgctcttaagccctc

SEQ ID NO: 11428 - DNA, 190 bp, Homo sapiens
  chr12:113909902-113910092
  hyper
ccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctcca

SEQ ID NO: 11429 - DNA, 157 bp, Homo sapiens
  chr12:113910529-113910686
  hyper
ctgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccag

SEQ ID NO: 11430 - DNA, 30 bp, Homo sapiens
  chr12:113913002-113913032
  hyper
atcccgacctaacagcgctaacagatggcg

SEQ ID NO: 11431 - DNA, 332 bp, Homo sapiens; identical to SEQ ID NO: 3952
  chr12:113913350-113913682
  hyper

SEQ ID NO: 11432 - DNA, 204 bp, Homo sapiens
  chr12:113914020-113914224
  hyper
ctggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 11433 - DNA, 35 bp, Homo sapiens
  chr12:113914300-113914335
  hyper
cgggccagagaggacgccggcggggtgcaatgggt

SEQ ID NO: 11434 - DNA, 328 bp, Homo sapiens
  chr12:113916261-113916589
  hyper
ctttggcagccccagcgctgcgtgtgtgtgtgtgtgcctgcgtgtgtgtgtgcgcgtgtgtgtgtgtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccc

SEQ ID NO: 11435 - DNA, 84 bp, Homo sapiens
  chr12:113917379-113917463
  hyper
gcagcttgttgaactcggagccagacgctttttctggcgaaacggagaaaaaacgccgcggaaacggtgcgcagggttggggag

SEQ ID NO: 11436 - DNA, 110 bp, Homo sapiens
  chr12:113917751-113917861
  hyper
gcagtgacagtgaaacgaattccaaacccattctgaactcgccatggcgctctcctgccctccaacacccaccccaaacaccgtgtaggcagaagcgaggttccccgtga

SEQ ID NO: 11437 - DNA, 170 bp, Homo sapiens
  chr12:113952952-113953122
  hyper
tggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttg

SEQ ID NO: 11438 - DNA, 295 bp, Homo sapiens
  chr12:113957660-113957955
  hyper
tcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcct

SEQ ID NO: 11439 - DNA, 66 bp, Homo sapiens
  chr12:114029765-114029831
  hyper
tctccctcagcacctcggcacctcggaggagcttctgctaattcactaccccgacaccgtctcatc

SEQ ID NO: 11440 - DNA, 41 bp, Homo sapiens
  chr12:114075780-114075821
  hyper
gctcgagttcaaggacgcagagaggacgggagggggttaaa

SEQ ID NO: 11441 - DNA, 46 bp, Homo sapiens
  chr12:114076041-114076087
  hyper
ggccggccacaaaggcgccagaaaaccctgccgtgttcggaagggt

SEQ ID NO: 11442 - DNA, 117 bp, Homo sapiens
  chr12:114833985-114834102
  hyper
ggccccgcggctgcccgaccccgggccgcgcgtctctaatctccggccgccgtggcccggccgcctccccggccgatagcgacgccgaccggggcggcgtggcgacagagagacgca

SEQ ID NO: 11443 - DNA, 358 bp, Homo sapiens; identical to SEQ ID NO: 3953
  chr12:114838380-114838738
  hyper

SEQ ID NO: 11444 - DNA, 86 bp, Homo sapiens
  chr12:114841046-114841132
  hyper
gcgcgcgggtctagtcggcggcgcggaggaggcaggaggaggcaggaggaggcgggaggaggcgaaggctacggaagatcagaaga

SEQ ID NO: 11445 - DNA, 72 bp, Homo sapiens
  chr12:114843007-114843079
  hyper
gcaagcagctttcttcgcctcgttctcggggcttcagggaggcggcgactggagccccgctgcctactcaca

SEQ ID NO: 11446 - DNA, 375 bp, Homo sapiens
  chr12:114843285-114843660
  hyper
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctcccta

SEQ ID NO: 11447 - DNA, 116 bp, Homo sapiens; identical to SEQ ID NO: 3954
  chr12:114844184-114844300
  hyper

SEQ ID NO: 11448 - DNA, 30 bp, Homo sapiens
  chr12:114846013-114846043
  hyper
gccacaggttccggacgtcttggccccggg

SEQ ID NO: 11449 - DNA, 476 bp, Homo sapiens; identical to SEQ ID NO: 3955
  chr12:114846471-114846947
  hyper

SEQ ID NO: 11450 - DNA, 122 bp, Homo sapiens; identical to SEQ ID NO: 3956
  chr12:114847042-114847164
  hyper

SEQ ID NO: 11451 - DNA, 272 bp, Homo sapiens; identical to SEQ ID NO: 3957
  chr12:114847165-114847437
  hyper

SEQ ID NO: 11452 - DNA, 78 bp, Homo sapiens; identical to SEQ ID NO: 3958
  chr12:114847577-114847655
  hyper

SEQ ID NO: 11453 - DNA, 30 bp, Homo sapiens
  chr12:114877303-114877333
  hyper
gctggtgaggccacccgctttgggacagaa

SEQ ID NO: 11454 - DNA, 32 bp, Homo sapiens
  chr12:114878562-114878594
  hyper
cagcgcgcgcatctgcggcactggctaaatcc

SEQ ID NO: 11455 - DNA, 204 bp, Homo sapiens
  chr12:114878808-114879012
  hyper
cgggaattgccacagacgcccgatttcctcggtgccatgtgggctcctagctgccgccacagagcggccggatcctaccagggtttcccagtgcccgggtacctgcaagaatcttcccaggacgggagcagtgggcactgagcagcgctgccgggagaaagatgttgcgttttgccaagcgctcacccgcgcttcaaaacccca

SEQ ID NO: 11456 - DNA, 390 bp, Homo sapiens
  chr12:114881656-114882046
  hyper
gtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgac

SEQ ID NO: 11457 - DNA, 62 bp, Homo sapiens
  chr12:114883473-114883535
  hyper
acataaatcctgcttcgagattaatctccctgctcgctcgcgctgggcgcagtgattttttt

SEQ ID NO: 11458 - DNA, 78 bp, Homo sapiens
  chr12:114918587-114918665
  hyper
ggagaaggcaagatccggcaggcgacgctgattagctgggggtctccgatgcgaccccggactcggagcaggaaatcc

SEQ ID NO: 11459 - DNA, 38 bp, Homo sapiens
  chr12:115106464-115106502
  hyper
cttttttccccaattcgggagagcgcaaccagccaact

SEQ ID NO: 11460 - DNA, 36 bp, Homo sapiens
  chr12:115121885-115121921
  hyper
agagagagagagagacggagtcggagagggagggag

SEQ ID NO: 11461 - DNA, 20 bp, Homo sapiens
  chr12:116946180-116946200
  hyper
ctggtccccaggctgcgcct

SEQ ID NO: 11462 - DNA, 261 bp, Homo sapiens
  chr12:117319805-117320066
  hyper
ctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaatt

SEQ ID NO: 11463 - DNA, 282 bp, Homo sapiens
  chr12:117798084-117798366
  hyper
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagag

SEQ ID NO: 11464 - DNA, 131 bp, Homo sapiens; identical to SEQ ID NO: 3959
  chr12:117799330-117799461
  hyper

SEQ ID NO: 11465 - DNA, 58 bp, Homo sapiens; identical to SEQ ID NO: 3960
  chr12:119212142-119212200
  hyper

SEQ ID NO: 11466 - DNA, 63 bp, Homo sapiens; identical to SEQ ID NO: 3961
  chr12:119212318-119212381
  hyper

SEQ ID NO: 11467 - DNA, 363 bp, Homo sapiens
  chr12:119418576-119418939
  hyper
actctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagct

SEQ ID NO: 11468 - DNA, 314 bp, Homo sapiens
  chr12:119419436-119419750
  hyper
tcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaa

SEQ ID NO: 11469 - DNA, 364 bp, Homo sapiens; identical to SEQ ID NO: 3962
  chr12:120032837-120033201
  hyper

SEQ ID NO: 11470 - DNA, 30 bp, Homo sapiens
  chr12:120807882-120807912
  hyper
actcctgtcctgattcgggaaacccggttc

SEQ ID NO: 11471 - DNA, 30 bp, Homo sapiens
  chr12:121566850-121566880
  hyper
gaggttggcccttgacgccctgtgtgatta

SEQ ID NO: 11472 - DNA, 372 bp, Homo sapiens
  chr12:122688669-122689041
  hyper
gtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccg

SEQ ID NO: 11473 - DNA, 58 bp, Homo sapiens
  chr12:123920539-123920597
  hyper
aaaagaaaaggaaggcgtctccctgccagtaggtgccctcctacgccccgcaggcgcc

SEQ ID NO: 11474 - DNA, 376 bp, Homo sapiens
  chr12:125534027-125534403
  hyper
agtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggg

SEQ ID NO: 11475 - DNA, 144 bp, Homo sapiens
  chr12:125670117-125670261
  hyper
cgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcg

SEQ ID NO: 11476 - DNA, 72 bp, Homo sapiens
  chr12:125670334-125670406
  hyper
cgccttcgctgtgtttcaggtcaccgcacccagcctgcgcacccctagcccccatcccggtgccgtgcagag

SEQ ID NO: 11477 - DNA, 84 bp, Homo sapiens
  chr12:125671581-125671665
  hyper
cgcctggggagagcccgcctgccttctcccccaaacccttagcttccttgcggatcctttcgggacgcacgggggccacagacc

SEQ ID NO: 11478 - DNA, 128 bp, Homo sapiens
  chr12:125672764-125672892
  hyper
tggcattgggcttaacgtggatgaatcttgcctgcttggctaaggagcagctatgatagctgttttgctttcggcattcctctgcggtccacgagaggggctgctgctggggccgaggctgttttctc

SEQ ID NO: 11479 - DNA, 117 bp, Homo sapiens
  chr12:126168505-126168622
  hyper
tggaggctgggccagcgttgcgagtcttgccagggacgcgcgctctagcgccggaggctgggaacgcaccgcggtgccaccgcgtcctgcaggggcggggcgcgcacctggggatgc

SEQ ID NO: 11480 - DNA, 30 bp, Homo sapiens
  chr12:126675806-126675836
  hyper
cgggcgcactttccccgcctgcatctgagg

SEQ ID NO: 11481 - DNA, 30 bp, Homo sapiens
  chr12:127212512-127212542
  hyper
acttaccgtaaggtgcggggtcttcttagg

SEQ ID NO: 11482 - DNA, 270 bp, Homo sapiens
  chr12:127765179-127765449
  hyper
tgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagg

SEQ ID NO: 11483 - DNA, 127 bp, Homo sapiens
  chr12:127865735-127865862
  hyper
ggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 11484 - DNA, 103 bp, Homo sapiens
  chr12:128751340-128751443
  hyper
cagctccgccttgagcgtcgggtccctgggcaggaccctccgggccacgggccgctgtccgttgggcacccgggcaggagtctgcgaacgctgagtttctctg

SEQ ID NO: 11485 - DNA, 153 bp, Homo sapiens; identical to SEQ ID NO: 3963
  chr12:128752114-128752267
  hyper

SEQ ID NO: 11486 - DNA, 73 bp, Homo sapiens
  chr12:128752499-128752572
  hyper
ccaggagggaaggcccggttctttgcatcccctttccgcaaccgctagggtctctgtgcgggccctagaggaa

SEQ ID NO: 11487 - DNA, 422 bp, Homo sapiens
  chr12:128752818-128753240
  hyper
cgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 11488 - DNA, 53 bp, Homo sapiens; identical to SEQ ID NO: 1075
  chr12:129337857-129337910
  hyper

SEQ ID NO: 11489 - DNA, 239 bp, Homo sapiens; identical to SEQ ID NO: 1076
  chr12:129338587-129338826
  hyper

SEQ ID NO: 11490 - DNA, 55 bp, Homo sapiens; identical to SEQ ID NO: 1077
  chr12:129338851-129338906
  hyper

SEQ ID NO: 11491 - DNA, 118 bp, Homo sapiens
  chr12:130387796-130387914
  hyper
cgtcctcacctttggaaaacagggcggccaggctgatgagtaccggcgaccagtggtgccacagcgtccccatctcagacgggcacatcctggagacccggagcgcagatcctccgct

SEQ ID NO: 11492 - DNA, 156 bp, Homo sapiens; identical to SEQ ID NO: 3967
  chr12:130388279-130388435
  hyper

SEQ ID NO: 11493 - DNA, 140 bp, Homo sapiens; identical to SEQ ID NO: 3968
  chr12:130389012-130389152
  hyper

SEQ ID NO: 11494 - DNA, 42 bp, Homo sapiens
  chr12:130526846-130526888
  hyper
caacaggctcctgcccggttcacctggggaagcgcagggctg

SEQ ID NO: 11495 - DNA, 121 bp, Homo sapiens
  chr12:130526931-130527052
  hyper
cggcagcttgcagggcccgctgtctccactagggggcggcgtacgcgcgtctctcgaagccgggacccgcgcggggaggctgcactggctggaaacagcgcctgggcgctcccgcggctcc

SEQ ID NO: 11496 - DNA, 73 bp, Homo sapiens
  chr12:130589236-130589309
  hyper
agcacgttgctatcccggatgaagggccatttcagccctaagctcaaagccggagctccgaccagcactctca

SEQ ID NO: 11497 - DNA, 333 bp, Homo sapiens
  chr12:130645294-130645627
  hyper
gaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagaga

SEQ ID NO: 11498 - DNA, 30 bp, Homo sapiens
  chr12:130646183-130646213
  hyper
caagcccgcacttcccgcggggtgggaggc

SEQ ID NO: 11499 - DNA, 21 bp, Homo sapiens
  chr12:130646633-130646654
  hyper
cgccgggaaagggggcgccgg

SEQ ID NO: 11500 - DNA, 118 bp, Homo sapiens
  chr12:130646955-130647073
  hyper
ggcggggcctgtcagcgctcggcttttctgcccccctttgcctttttgcgagtcttctcatcccgggacgcaaacctcgaaacagctgccggctggtcccggccgaggccggcgcagg

SEQ ID NO: 11501 - DNA, 120 bp, Homo sapiens; identical to SEQ ID NO: 1078
  chr12:130647950-130648070
  hyper

SEQ ID NO: 11502 - DNA, 118 bp, Homo sapiens
  chr12:131200387-131200505
  hyper
cggggccgtgtccatcgggtgccaaactttgcctggaggggcctttcttaaaagcctggggtgggggccatgacagagccacagcacccctgcagctgacacccggcacccaggaaga

SEQ ID NO: 11503 - DNA, 77 bp, Homo sapiens
  chr12:132312753-132312830
  hyper
gcgtcctaagacacccggggaaacgccttccctgtgatgccgcggacccagtcccgtcgcggacacggcggggcggg

SEQ ID NO: 11504 - DNA, 33 bp, Homo sapiens
  chr12:132312856-132312889
  hyper
cgggccctttaaggcggccggcctcgttagcat

SEQ ID NO: 11505 - DNA, 298 bp, Homo sapiens
  chr12:132313288-132313586
  hyper
agtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttcc

SEQ ID NO: 11506 - DNA, 78 bp, Homo sapiens
  chr12:133194973-133195051
  hyper
cgaagccccggcagccgcggcaggaaccggcctggacggggtggggggcgccgcggaggccggcgggacttcccatgt

SEQ ID NO: 11507 - DNA, 30 bp, Homo sapiens
  chr12:133195488-133195518
  hyper
gacgcccaaggtgatcgtggtgaggaaccg

SEQ ID NO: 11508 - DNA, 33 bp, Homo sapiens
  chr12:133463690-133463723
  hyper
gagcgcacactgcaccgccgcccgtgtggcctg

SEQ ID NO: 11509 - DNA, 61 bp, Homo sapiens
  chr12:133464480-133464541
  hyper
cctaggagtagaagacggtccatcttagttgtcacgaggtagtgcacgtggggaccctttc

SEQ ID NO: 11510 - DNA, 15 bp, Homo sapiens
  chr12:133481368-133481383
  hyper
gaagcttttcctcac

SEQ ID NO: 11511 - DNA, 31 bp, Homo sapiens; identical to SEQ ID NO: 1080
  chr12:133481489-133481520
  hyper

SEQ ID NO: 11512 - DNA, 134 bp, Homo sapiens; identical to SEQ ID NO: 1081
  chr12:133481521-133481655
  hyper

SEQ ID NO: 11513 - DNA, 187 bp, Homo sapiens; identical to SEQ ID NO: 1082
  chr12:133485161-133485348
  hyper

SEQ ID NO: 11514 - DNA, 251 bp, Homo sapiens; identical to SEQ ID NO: 1083
  chr12:133485439-133485690
  hyper

SEQ ID NO: 11515 - DNA, 67 bp, Homo sapiens
  chr13:20735465-20735532
  hyper
catgcccgcgcgggacgtgagaggagagccgagggctgttggggcgggcccgacccgcttgcggggc

SEQ ID NO: 11516 - DNA, 490 bp, Homo sapiens
  chr13:20735533-20736023
  hyper
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgt

SEQ ID NO: 11517 - DNA, 30 bp, Homo sapiens
  chr13:20805970-20806000
  hyper
agtcaaaggggaccacgctggggtaaaagt

SEQ ID NO: 11518 - DNA, 43 bp, Homo sapiens
  chr13:21520313-21520356
  hyper
agggtgtgaagagatcgggagtcctctgcgaggctctggagca

SEQ ID NO: 11519 - DNA, 30 bp, Homo sapiens
  chr13:21634799-21634829
  hyper
aggcggcgcagccaccgggggctgaggggc

SEQ ID NO: 11520 - DNA, 419 bp, Homo sapiens
  chr13:21649623-21650042
  hyper
aaataatcacagaaacgaatatctgctgcgaagcagtaggaagtgccctgcggtctgtttcccctagcagagactggccttgtggcggaagacccccgcgcgtagggagggccggtgcggcgactccgggcggggcgcgctgttggtgtccagggcgcggagcctgcgccagcttcacaaaagcggtgtggacgcctgagccagtccgctcttgctggacggctccccatagtttagcccaaaaatccccctctgggtggctctggcaggagtgatttagggccacaattaggttggacgaggagtggggacttgccccgagctgcctttgcagacccggcggcggcgttctccccaaggctgcccgcttggctgcgcggctgaggcgagttgaggacccagcccgtccccaactctcc

SEQ ID NO: 11521 - DNA, 30 bp, Homo sapiens
  chr13:22243439-22243469
  hyper
ctgctgtaaataccacggggcagggctctc

SEQ ID NO: 11522 - DNA, 243 bp, Homo sapiens
  chr13:23489728-23489971
  hyper
aaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcg

SEQ ID NO: 11523 - DNA, 481 bp, Homo sapiens; identical to SEQ ID NO: 1084
  chr13:23733629-23734110
  hyper

SEQ ID NO: 11524 - DNA, 59 bp, Homo sapiens
  chr13:24153660-24153719
  hyper
ctgggaaggtaggtgcgtcgctgtccccggcgcgcggcgtcccgcgaggtcttcagccc

SEQ ID NO: 11525 - DNA, 218 bp, Homo sapiens
  chr13:24477613-24477831
  hyper
aggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggg

SEQ ID NO: 11526 - DNA, 138 bp, Homo sapiens
  chr13:25255004-25255142
  hyper
ggggcaaggggaggccgcctttcctctgagcgccccccggcctgggcaccgcttctctgactccccgccacggctccgtgcggccgccggggctggctggggaaagaagccagtccagaggagcgagaaggggccaag

SEQ ID NO: 11527 - DNA, 75 bp, Homo sapiens; identical to SEQ ID NO: 1085
  chr13:25319830-25319905
  hyper

SEQ ID NO: 11528 - DNA, 70 bp, Homo sapiens; identical to SEQ ID NO: 3977
  chr13:25320387-25320457
  hyper

SEQ ID NO: 11529 - DNA, 295 bp, Homo sapiens; identical to SEQ ID NO: 1086
  chr13:25320734-25321029
  hyper

SEQ ID NO: 11530 - DNA, 1072 bp, Homo sapiens; identical to SEQ ID NO: 1087
  chr13:25321112-25322184
  hyper

SEQ ID NO: 11531 - DNA, 32 bp, Homo sapiens
  chr13:25620922-25620954
  hyper
gtgaagcatcagacacgctggcgcatggggac

SEQ ID NO: 11532 - DNA, 13 bp, Homo sapiens
  chr13:25620955-25620968
  hyper
aggagccctggag

SEQ ID NO: 11533 - DNA, 52 bp, Homo sapiens
  chr13:25621342-25621394
  hyper
ggaaactgtcctgggcgcgcaccgcccccgtgccctgcgccctcctcatttg

SEQ ID NO: 11534 - DNA, 26 bp, Homo sapiens
  chr13:25744709-25744735
  hyper
aggcagggtctggggcggcgggcgcc

SEQ ID NO: 11535 - DNA, 295 bp, Homo sapiens; identical to SEQ ID NO: 1089
  chr13:25745300-25745595
  hyper

SEQ ID NO: 11536 - DNA, 221 bp, Homo sapiens; identical to SEQ ID NO: 1090
  chr13:25745726-25745947
  hyper

SEQ ID NO: 11537 - DNA, 39 bp, Homo sapiens
  chr13:25945978-25946017
  hyper
ccaagccctccccatcgccttccccgacacctaaaagcc

SEQ ID NO: 11538 - DNA, 76 bp, Homo sapiens
  chr13:25946300-25946376
  hyper
cgtagcctccgtctctcgcccggggccgccgagcccccgacacgggcgagatgctgaacggcgcaggcctggacaa

SEQ ID NO: 11539 - DNA, 54 bp, Homo sapiens; identical to SEQ ID NO: 1091
  chr13:25946620-25946674
  hyper

SEQ ID NO: 11540 - DNA, 18 bp, Homo sapiens
  chr13:25946801-25946819
  hyper
cggcgcagagaagatgca

SEQ ID NO: 11541 - DNA, 403 bp, Homo sapiens; identical to SEQ ID NO: 3985
  chr13:26042768-26043171
  hyper

SEQ ID NO: 11542 - DNA, 159 bp, Homo sapiens; identical to SEQ ID NO: 3986
  chr13:26043340-26043499
  hyper

SEQ ID NO: 11543 - DNA, 30 bp, Homo sapiens
  chr13:26624792-26624822
  hyper
ggggccgtctttgtccgcccggccaggctc

SEQ ID NO: 11544 - DNA, 139 bp, Homo sapiens
  chr13:26625380-26625519
  hyper
cagtcagaaggcccccggggctgtcgtccggaagcctctggaggtttcactggcaaccggaccctccctgagcatccccgaagggatgctcactcgagccgaatgaccgctgggcgcgccgccgcggacctggagccag

SEQ ID NO: 11545 - DNA, 30 bp, Homo sapiens
  chr13:27050496-27050526
  hyper
acctagggagggcagcgggcaggctgggct

SEQ ID NO: 11546 - DNA, 168 bp, Homo sapiens
  chr13:27131553-27131721
  hyper
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtga

SEQ ID NO: 11547 - DNA, 308 bp, Homo sapiens
  chr13:27132002-27132310
  hyper
tggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtgg

SEQ ID NO: 11548 - DNA, 107 bp, Homo sapiens
  chr13:27132629-27132736
  hyper
cggggtatcatccccgggggtctttacccgcgcgcctgggctttagcgagggcagaagcttcctctcagtttgtggtgctgacgtgcaatggcgattgcttcttgat

SEQ ID NO: 11549 - DNA, 419 bp, Homo sapiens; identical to SEQ ID NO: 3987
  chr13:27334304-27334723
  hyper

SEQ ID NO: 11550 - DNA, 238 bp, Homo sapiens; identical to SEQ ID NO: 3988
  chr13:27334724-27334962
  hyper

SEQ ID NO: 11551 - DNA, 30 bp, Homo sapiens
  chr13:28363673-28363703
  hyper
gaaagaaggaaagcccgggacaacagaaat

SEQ ID NO: 11552 - DNA, 91 bp, Homo sapiens; identical to SEQ ID NO: 3989
  chr13:28365659-28365750
  hyper

SEQ ID NO: 11553 - DNA, 139 bp, Homo sapiens
  chr13:28365956-28366095
  hyper
aaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 11554 - DNA, 95 bp, Homo sapiens; identical to SEQ ID NO: 1093
  chr13:28366482-28366577
  hyper

SEQ ID NO: 11555 - DNA, 34 bp, Homo sapiens
  chr13:28367005-28367039
  hyper
tctgcgtcaccgcctcgcagctgcatgggccccc

SEQ ID NO: 11556 - DNA, 152 bp, Homo sapiens; identical to SEQ ID NO: 1094
  chr13:28367794-28367946
  hyper

SEQ ID NO: 11557 - DNA, 84 bp, Homo sapiens; identical to SEQ ID NO: 1095
  chr13:28368153-28368237
  hyper

SEQ ID NO: 11558 - DNA, 77 bp, Homo sapiens; identical to SEQ ID NO: 1096
  chr13:28368994-28369071
  hyper

SEQ ID NO: 11559 - DNA, 850 bp, Homo sapiens; identical to SEQ ID NO: 1097
  chr13:28369161-28370011
  hyper

SEQ ID NO: 11560 - DNA, 382 bp, Homo sapiens; identical to SEQ ID NO: 3995
  chr13:28370980-28371362
  hyper

SEQ ID NO: 11561 - DNA, 30 bp, Homo sapiens
  chr13:28394743-28394773
  hyper
ccaggcagagagggccggaaaggcagccca

SEQ ID NO: 11562 - DNA, 402 bp, Homo sapiens; identical to SEQ ID NO: 3996
  chr13:28395255-28395657
  hyper

SEQ ID NO: 11563 - DNA, 140 bp, Homo sapiens
  chr13:28396578-28396718
  hyper
ttcttaattttgtggcgatcattcatggaagcaaaaaaggctacagtgtcctttttaagaaaagaaaagctaattcttgaagtgaccttggcagtctggtgcgtgccccatccgaacagagagggcggcttgtgtcaaca

SEQ ID NO: 11564 - DNA, 30 bp, Homo sapiens
  chr13:28397439-28397469
  hyper
agcccttggccctggcggggaaacagaatt

SEQ ID NO: 11565 - DNA, 196 bp, Homo sapiens; identical to SEQ ID NO: 3997
  chr13:28491793-28491989
  hyper

SEQ ID NO: 11566 - DNA, 181 bp, Homo sapiens; identical to SEQ ID NO: 3998
  chr13:28492244-28492425
  hyper

SEQ ID NO: 11567 - DNA, 127 bp, Homo sapiens; identical to SEQ ID NO: 3999
  chr13:28492426-28492553
  hyper

SEQ ID NO: 11568 - DNA, 36 bp, Homo sapiens
  chr13:28527866-28527902
  hyper
ttttaagagccacagcgccaccgagagagtggaaag

SEQ ID NO: 11569 - DNA, 456 bp, Homo sapiens
  chr13:28528225-28528681
  hyper
cggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcag

SEQ ID NO: 11570 - DNA, 117 bp, Homo sapiens
  chr13:28535406-28535523
  hyper
cctcttgctgtttcccggctctgctcatcttccccaactgcccttaaggcgcctccgtgggcgcgctgattaggctctcggatgttggtgggaagatcgaaacgaagggctaagccc

SEQ ID NO: 11571 - DNA, 37 bp, Homo sapiens
  chr13:28541213-28541250
  hyper
ccgcggccgctctcccgggacacgcaaaggtcttcct

SEQ ID NO: 11572 - DNA, 50 bp, Homo sapiens
  chr13:28542677-28542727
  hyper
gctgctcggcggcagcggtggcggcgggcccaggagggccggggttgagc

SEQ ID NO: 11573 - DNA, 33 bp, Homo sapiens
  chr13:28542728-28542761
  hyper
tttgcagcagcccagaagcgcaggaaggcgcgg

SEQ ID NO: 11574 - DNA, 137 bp, Homo sapiens
  chr13:28542969-28543106
  hyper
cgcgctgtccaagttcgctgccgctgcagctgcggccgccacgtggtaaccgccgtagtccgggtactgcggggggctgacgaagttctgcggcgccaggttgaggccgccagagtggcgcacggagctagggtaca

SEQ ID NO: 11575 - DNA, 58 bp, Homo sapiens
  chr13:28543378-28543436
  hyper
actaggctgcagaggcggggaagacccgccacaggctggcgtgcggagccccaggccg

SEQ ID NO: 11576 - DNA, 195 bp, Homo sapiens; identical to SEQ ID NO: 4000
  chr13:28544390-28544585
  hyper

SEQ ID NO: 11577 - DNA, 217 bp, Homo sapiens; identical to SEQ ID NO: 4001
  chr13:28544665-28544882
  hyper

SEQ ID NO: 11578 - DNA, 395 bp, Homo sapiens; identical to SEQ ID NO: 4002
  chr13:28549497-28549892
  hyper

SEQ ID NO: 11579 - DNA, 20 bp, Homo sapiens
  chr13:28550239-28550259
  hyper
cgccgcgcagccagctctct

SEQ ID NO: 11580 - DNA, 264 bp, Homo sapiens; identical to SEQ ID NO: 4003
  chr13:28551285-28551549
  hyper

SEQ ID NO: 11581 - DNA, 37 bp, Homo sapiens; identical to SEQ ID NO: 4004
  chr13:28551658-28551695
  hyper

SEQ ID NO: 11582 - DNA, 127 bp, Homo sapiens
  chr13:28552077-28552204
  hyper
aaaggactcattactcgtatgattgcctcaattctccacttcctttgtgcacgtgtgtggacgctgttccaggcccgagtccgcctcccgcccaggacgcacagctccgggccgtggcccccgcgcg

SEQ ID NO: 11583 - DNA, 30 bp, Homo sapiens
  chr13:28553143-28553173
  hyper
aacatccatggggctcggcaaataaatgcc

SEQ ID NO: 11584 - DNA, 171 bp, Homo sapiens; identical to SEQ ID NO: 1098
  chr13:28674056-28674227
  hyper

SEQ ID NO: 11585 - DNA, 436 bp, Homo sapiens; identical to SEQ ID NO: 1099
  chr13:28674720-28675156
  hyper

SEQ ID NO: 11586 - DNA, 1213 bp, Homo sapiens; identical to SEQ ID NO: 1100
  chr13:29067773-29068986
  hyper

SEQ ID NO: 11587 - DNA, 182 bp, Homo sapiens; identical to SEQ ID NO: 1101
  chr13:29068993-29069175
  hyper

SEQ ID NO: 11588 - DNA, 32 bp, Homo sapiens
  chr13:29069551-29069583
  hyper
cctcctcctgcccatcgcgctcaggaaatcct

SEQ ID NO: 11589 - DNA, 114 bp, Homo sapiens; identical to SEQ ID NO: 1102
  chr13:29106308-29106422
  hyper

SEQ ID NO: 11590 - DNA, 392 bp, Homo sapiens; identical to SEQ ID NO: 1103
  chr13:29106423-29106815
  hyper

SEQ ID NO: 11591 - DNA, 60 bp, Homo sapiens; identical to SEQ ID NO: 1104
  chr13:29106898-29106958
  hyper

SEQ ID NO: 11592 - DNA, 44 bp, Homo sapiens
  chr13:29393656-29393700
  hyper
caatgcctcctgctgcgcctaattcgaagcggctccctcttctg

SEQ ID NO: 11593 - DNA, 62 bp, Homo sapiens
  chr13:29394849-29394911
  hyper
ccgggctcggggcagcgccgggctggttcggcttctcgtctccagagcgctgatgcttcctg

SEQ ID NO: 11594 - DNA, 212 bp, Homo sapiens; identical to SEQ ID NO: 4012
  chr13:33591219-33591431
  hyper

SEQ ID NO: 11595 - DNA, 7 bp, Homo sapiens
  chr13:36705559-36705566
  hyper
gctcaca

SEQ ID NO: 11596 - DNA, 30 bp, Homo sapiens
  chr13:36729247-36729277
  hyper
ggcggcgccttcccccggcgtccccaaata

SEQ ID NO: 11597 - DNA, 68 bp, Homo sapiens
  chr13:36919889-36919957
  hyper
ataaccgcagttgttcgtgggccttcttgcagagaaaggctgcccaaccttgacggggccatgggcgc

SEQ ID NO: 11598 - DNA, 187 bp, Homo sapiens
  chr13:36920598-36920785
  hyper
tcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaa

SEQ ID NO: 11599 - DNA, 108 bp, Homo sapiens; identical to SEQ ID NO: 4013
  chr13:37005473-37005581
  hyper

SEQ ID NO: 11600 - DNA, 164 bp, Homo sapiens; identical to SEQ ID NO: 4014
  chr13:37005899-37006063
  hyper

SEQ ID NO: 11601 - DNA, 192 bp, Homo sapiens; identical to SEQ ID NO: 4015
  chr13:37006433-37006625
  hyper

SEQ ID NO: 11602 - DNA, 30 bp, Homo sapiens
  chr13:37248608-37248638
  hyper
caatgtccttggccccgtgttgacctgcct

SEQ ID NO: 11603 - DNA, 15 bp, Homo sapiens
  chr13:37248979-37248994
  hyper
gttttccctagctcc

SEQ ID NO: 11604 - DNA, 124 bp, Homo sapiens
  chr13:39261149-39261273
  hyper
ctggagtaaggggtgcgagcggagggatttccctcaaagcccagggtccggggacctggaaagtagaagtggagggattcaattctccgcgcgattgaggcgctagcggcggagctggacggcc

SEQ ID NO: 11605 - DNA, 112 bp, Homo sapiens
  chr13:39262129-39262241
  hyper
cgcgtgggcatcctgtccggcttgggcgcgctgcctcgctatggagaactcctccactacccgcaggtccctggaggagccagagagggaggcgccccggagactctcctga

SEQ ID NO: 11606 - DNA, 517 bp, Homo sapiens; identical to SEQ ID NO: 4016
  chr13:43566059-43566576
  hyper

SEQ ID NO: 11607 - DNA, 62 bp, Homo sapiens
  chr13:44360732-44360794
  hyper
ccccggctcggagcccggacgccccagggaggctgcgggccccggagctgcttacctggggc

SEQ ID NO: 11608 - DNA, 739 bp, Homo sapiens; identical to SEQ ID NO: 1105
  chr13:44947737-44948476
  hyper

SEQ ID NO: 11609 - DNA, 67 bp, Homo sapiens
  chr13:46189867-46189934
  hyper
gtttgtggcagctctcggttaccatgggaaccgcactccgcagcctccctgggccccatctaatctg

SEQ ID NO: 11610 - DNA, 102 bp, Homo sapiens
  chr13:46961491-46961593
  hyper
gcaaagcgccgttcccgccgcaggcaccgagacgtcgcccagatggaagaaactctggagatgcgcgctcctacaccggtgccgcggcgcccgggcccagca

SEQ ID NO: 11611 - DNA, 780 bp, Homo sapiens; identical to SEQ ID NO: 1106
  chr13:49794146-49794926
  hyper

SEQ ID NO: 11612 - DNA, 106 bp, Homo sapiens
  chr13:50070552-50070658
  hyper
tgtcaactctcctagcgcccctccgctcaccggtaaaccaggacagtggaggggcgccctgatgcggtgaggcagggggcggccctgagggaagagctgggtctca

SEQ ID NO: 11613 - DNA, 30 bp, Homo sapiens
  chr13:52979780-52979810
  hyper
ctccttaatgaggaccgtctttaatttaat

SEQ ID NO: 11614 - DNA, 43 bp, Homo sapiens
  chr13:52980066-52980109
  hyper
tgaggtggcagagtccggaggcatttcccgaccccagaggagc

SEQ ID NO: 11615 - DNA, 336 bp, Homo sapiens; identical to SEQ ID NO: 1107
  chr13:53312978-53313314
  hyper

SEQ ID NO: 11616 - DNA, 17 bp, Homo sapiens
  chr13:53313512-53313529
  hyper
cgcagcacagggccttc

SEQ ID NO: 11617 - DNA, 83 bp, Homo sapiens; identical to SEQ ID NO: 1109
  chr13:53313530-53313613
  hyper

SEQ ID NO: 11618 - DNA, 37 bp, Homo sapiens; identical to SEQ ID NO: 1110
  chr13:53313677-53313714
  hyper

SEQ ID NO: 11619 - DNA, 41 bp, Homo sapiens
  chr13:53419734-53419775
  hyper
ctcctttccaaaacccggggaggcaccgtagggctgcagca

SEQ ID NO: 11620 - DNA, 32 bp, Homo sapiens
  chr13:53422842-53422874
  hyper
tggccgcctccccctcgcgtcgcccctccgcc

SEQ ID NO: 11621 - DNA, 30 bp, Homo sapiens
  chr13:53423168-53423198
  hyper
attttgcacctctgacgcttccaaaccctt

SEQ ID NO: 11622 - DNA, 98 bp, Homo sapiens
  chr13:53423948-53424046
  hyper
gaaacctggcaggaacgtggggggaacttaaccatctgcttaggaaagtgtggagcttcggcactgccaaaatctgggctgggcggatcctggggctg

SEQ ID NO: 11623 - DNA, 292 bp, Homo sapiens
  chr13:58203602-58203894
  hyper
cagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggacc

SEQ ID NO: 11624 - DNA, 154 bp, Homo sapiens
  chr13:58204239-58204393
  hyper
tcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttat

SEQ ID NO: 11625 - DNA, 343 bp, Homo sapiens
  chr13:58205889-58206232
  hyper
ctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 11626 - DNA, 210 bp, Homo sapiens
  chr13:58206452-58206662
  hyper
cgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgccc

SEQ ID NO: 11627 - DNA, 247 bp, Homo sapiens
  chr13:58207567-58207814
  hyper
cgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgac

SEQ ID NO: 11628 - DNA, 71 bp, Homo sapiens
  chr13:58207891-58207962
  hyper
cgggcccgggggttccgtccccttcaagcttgaggagaactacgacaacttctacacggtggtgactgacc

SEQ ID NO: 11629 - DNA, 592 bp, Homo sapiens; identical to SEQ ID NO: 1111
  chr13:58208334-58208926
  hyper

SEQ ID NO: 11630 - DNA, 69 bp, Homo sapiens
  chr13:67804675-67804744
  hyper
tggccccaggagagccgggttccatgaggtgcactgagcatgctctgcagggtccggcgtgggagggac

SEQ ID NO: 11631 - DNA, 23 bp, Homo sapiens
  chr13:67804745-67804768
  hyper
cgctggcgctccccaggcccggg

SEQ ID NO: 11632 - DNA, 236 bp, Homo sapiens
  chr13:67804863-67805099
  hyper
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatag

SEQ ID NO: 11633 - DNA, 152 bp, Homo sapiens; identical to SEQ ID NO: 4024
  chr13:70681626-70681778
  hyper

SEQ ID NO: 11634 - DNA, 205 bp, Homo sapiens; identical to SEQ ID NO: 4025
  chr13:70681866-70682071
  hyper

SEQ ID NO: 11635 - DNA, 30 bp, Homo sapiens
  chr13:74707261-74707291
  hyper
agttacacatcattacgaccagagacaata

SEQ ID NO: 11636 - DNA, 130 bp, Homo sapiens
  chr13:75149921-75150051
  hyper
cggcccggagaggctcgcggatgcctggccgcgcgcctccgcgggacgtcagcgcccgcggcacgatctgctgctgtcactatcagtatccggcaggagcccgcccgccccggcccggccccaggccgtg

SEQ ID NO: 11637 - DNA, 86 bp, Homo sapiens; identical to SEQ ID NO: 4026
  chr13:78493110-78493196
  hyper

SEQ ID NO: 11638 - DNA, 414 bp, Homo sapiens
  chr13:78493520-78493934
  hyper
cgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaa

SEQ ID NO: 11639 - DNA, 35 bp, Homo sapiens
  chr13:79161007-79161042
  hyper
actcgggaccattgccgggacgagaagcccatcag

SEQ ID NO: 11640 - DNA, 37 bp, Homo sapiens; identical to SEQ ID NO: 1112
  chr13:79170347-79170384
  hyper

SEQ ID NO: 11641 - DNA, 372 bp, Homo sapiens; identical to SEQ ID NO: 1113
  chr13:79170467-79170839
  hyper

SEQ ID NO: 11642 - DNA, 242 bp, Homo sapiens; identical to SEQ ID NO: 1114
  chr13:79175702-79175944
  hyper

SEQ ID NO: 11643 - DNA, 49 bp, Homo sapiens; identical to SEQ ID NO: 1115
  chr13:79176077-79176126
  hyper

SEQ ID NO: 11644 - DNA, 145 bp, Homo sapiens; identical to SEQ ID NO: 1116
  chr13:79176276-79176421
  hyper

SEQ ID NO: 11645 - DNA, 224 bp, Homo sapiens; identical to SEQ ID NO: 1117
  chr13:79176608-79176832
  hyper

SEQ ID NO: 11646 - DNA, 104 bp, Homo sapiens; identical to SEQ ID NO: 1118
  chr13:79177081-79177185
  hyper

SEQ ID NO: 11647 - DNA, 318 bp, Homo sapiens; identical to SEQ ID NO: 1119
  chr13:79177305-79177623
  hyper

SEQ ID NO: 11648 - DNA, 175 bp, Homo sapiens; identical to SEQ ID NO: 1120
  chr13:79177885-79178060
  hyper

SEQ ID NO: 11649 - DNA, 60 bp, Homo sapiens
  chr13:79182844-79182904
  hyper
cataggaagttctgtcgccttcctgctccgcggatagccgcctgccgtctgctgccacca

SEQ ID NO: 11650 - DNA, 18 bp, Homo sapiens
  chr13:79183406-79183424
  hyper
actctttgttggtttcgc

SEQ ID NO: 11651 - DNA, 108 bp, Homo sapiens
  chr13:84455572-84455680
  hyper
aaacgtcccctgtaacgtttccagcggcaaaacaaagagacgtctccagcaacagaatccaaagcagcatttttaaagcgagcaattcatccccgatctcatcacaaa

SEQ ID NO: 11652 - DNA, 236 bp, Homo sapiens
  chr13:84456111-84456347
  hyper
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtc

SEQ ID NO: 11653 - DNA, 346 bp, Homo sapiens; identical to SEQ ID NO: 4036
  chr13:88323468-88323814
  hyper

SEQ ID NO: 11654 - DNA, 177 bp, Homo sapiens
  chr13:88324342-88324519
  hyper
gggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 11655 - DNA, 30 bp, Homo sapiens
  chr13:88325619-88325649
  hyper
tgagaggaagctcttcgacccttgctaact

SEQ ID NO: 11656 - DNA, 15 bp, Homo sapiens
  chr13:88326936-88326951
  hyper
cgtggtagtgaagtc

SEQ ID NO: 11657 - DNA, 292 bp, Homo sapiens
  chr13:92051108-92051400
  hyper
gcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 11658 - DNA, 113 bp, Homo sapiens
  chr13:92051401-92051514
  hyper
gaaacttttccagtggcggctgctgggagctgtcagggggctgccggattcgccgcgggcaggtaaggggcaatgagggggtctctggactggcggcgtccgagcccggcctt

SEQ ID NO: 11659 - DNA, 20 bp, Homo sapiens
  chr13:93879283-93879303
  hyper
tcccgggggagccggcgcgc

SEQ ID NO: 11660 - DNA, 157 bp, Homo sapiens
  chr13:93879304-93879461
  hyper
ctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggg

SEQ ID NO: 11661 - DNA, 11 bp, Homo sapiens
  chr13:93880206-93880217
  hyper
gagagccgagc

SEQ ID NO: 11662 - DNA, 15 bp, Homo sapiens
  chr13:93880533-93880548
  hyper
cgttagggttcctca

SEQ ID NO: 11663 - DNA, 30 bp, Homo sapiens
  chr13:95354328-95354358
  hyper
ggccatgggtgggggcgggtggtgaagctg

SEQ ID NO: 11664 - DNA, 30 bp, Homo sapiens
  chr13:95357311-95357341
  hyper
tttgtctcctcaaagcgactcccaatggat

SEQ ID NO: 11665 - DNA, 201 bp, Homo sapiens
  chr13:95357574-95357775
  hyper
gagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaa

SEQ ID NO: 11666 - DNA, 105 bp, Homo sapiens
  chr13:95359719-95359824
  hyper
cttgcctggaggacacggcggcccaggcggccgggagcgccggcgccgagccgcgctctgattggctggcgcgaccgtccctatctgctccggggagagtggaat

SEQ ID NO: 11667 - DNA, 173 bp, Homo sapiens
  chr13:95360231-95360404
  hyper
aaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctcc

SEQ ID NO: 11668 - DNA, 322 bp, Homo sapiens
  chr13:95363009-95363331
  hyper
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctg

SEQ ID NO: 11669 - DNA, 368 bp, Homo sapiens
  chr13:95363592-95363960
  hyper
cgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccgg

SEQ ID NO: 11670 - DNA, 132 bp, Homo sapiens
  chr13:95364064-95364196
  hyper
cgcggccggtacttgtagtcggggtgctccttcatgtgcatggcgcgtagacgcttggcctcgtcgatgaacggccgcttctccgactctgtgagcagtttccactcggcgcccaagcgcttgctgatctcc

SEQ ID NO: 11671 - DNA, 211 bp, Homo sapiens
  chr13:95364731-95364942
  hyper
ttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatat

SEQ ID NO: 11672 - DNA, 129 bp, Homo sapiens
  chr13:95365239-95365368
  hyper
ttcaggcgcgcctgccgacttagggctcccggagctcgccggccgcggagggcagcgcagcctccacgcggcgccgcaggcctggcaccggccgcgtccccgcctcgctcttctcggcagccgcctggc

SEQ ID NO: 11673 - DNA, 503 bp, Homo sapiens
  chr13:95619803-95620306
  hyper
agagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 11674 - DNA, 475 bp, Homo sapiens
  chr13:95620307-95620782
  hyper
ctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggaggagcgaggctgctgccgtccccggggaaagggcgacttcggcggggataccccgtgccaggccctgcaactcccgggccctcgggaatgggatgggggaggcgcggggtgcgcgcagctcccggtgatgttaagg

SEQ ID NO: 11675 - DNA, 87 bp, Homo sapiens
  chr13:95620853-95620940
  hyper
cgctgcggccgctgtgtgcccgaggggcggctctgtaacccggctccaggcatttcttaggtttcccatccccgccctccaagctcc

SEQ ID NO: 11676 - DNA, 93 bp, Homo sapiens
  chr13:95655093-95655186
  hyper
ctagctgtgtccacacggcccctccgaagcgccttggccccagctgcactctcctcgcccccttcctcccagtgggaacgagccagccagcga

SEQ ID NO: 11677 - DNA, 379 bp, Homo sapiens
  chr13:96204922-96205301
  hyper
cgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgccccc

SEQ ID NO: 11678 - DNA, 173 bp, Homo sapiens; identical to SEQ ID NO: 4037
  chr13:96296383-96296556
  hyper

SEQ ID NO: 11679 - DNA, 110 bp, Homo sapiens; identical to SEQ ID NO: 4038
  chr13:96296840-96296950
  hyper

SEQ ID NO: 11680 - DNA, 229 bp, Homo sapiens; identical to SEQ ID NO: 4039
  chr13:96296991-96297220
  hyper

SEQ ID NO: 11681 - DNA, 150 bp, Homo sapiens
  chr13:96743424-96743574
  hyper
agaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacat

SEQ ID NO: 11682 - DNA, 107 bp, Homo sapiens
  chr13:96743788-96743895
  hyper
aagaaggactgtccccgcaaccacagccacaccaggtactgtcgcccgctgggtctctgttcttcccccccaccccccatccctcttcctcagtcctgacccagagc

SEQ ID NO: 11683 - DNA, 151 bp, Homo sapiens
  chr13:96743896-96744047
  hyper
accccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgcc

SEQ ID NO: 11684 - DNA, 344 bp, Homo sapiens; identical to SEQ ID NO: 4040
  chr13:100608461-100608805
  hyper

SEQ ID NO: 11685 - DNA, 103 bp, Homo sapiens; identical to SEQ ID NO: 4041
  chr13:100608838-100608941
  hyper

SEQ ID NO: 11686 - DNA, 30 bp, Homo sapiens
  chr13:100611911-100611941
  hyper
gcacagggctggaggcgacccttcaaagcg

SEQ ID NO: 11687 - DNA, 51 bp, Homo sapiens
  chr13:100621941-100621992
  hyper
aggcgcttgccggggcggcccggcctctctttccatcgccctcccagactt

SEQ ID NO: 11688 - DNA, 33 bp, Homo sapiens
  chr13:100622452-100622485
  hyper
agggaaagggcttctcgccggtgtgcacgcgga

SEQ ID NO: 11689 - DNA, 34 bp, Homo sapiens
  chr13:100622959-100622993
  hyper
gggcggccgccgctgcggccgcaaccgccccgta

SEQ ID NO: 11690 - DNA, 43 bp, Homo sapiens
  chr13:100624559-100624602
  hyper
acccaacctgcctagcgctcacctagggcgcatagacagtaga

SEQ ID NO: 11691 - DNA, 150 bp, Homo sapiens; identical to SEQ ID NO: 4042
  chr13:100630730-100630880
  hyper

SEQ ID NO: 11692 - DNA, 90 bp, Homo sapiens
  chr13:100635085-100635175
  hyper
aatctgcaagtggatcgaccccgagcaactgagcaatcccaagaagagctgcaacaaaactttcagcaccatgcacgagctggtgacaca

SEQ ID NO: 11693 - DNA, 30 bp, Homo sapiens
  chr13:100636167-100636197
  hyper
caaaatcgtgccagacgatttcctaaaaga

SEQ ID NO: 11694 - DNA, 34 bp, Homo sapiens
  chr13:100637006-100637040
  hyper
aatgagcaggactgtcgggcgggaaggcggttaa

SEQ ID NO: 11695 - DNA, 101 bp, Homo sapiens
  chr13:100637423-100637524
  hyper
ccggaccacctcagccggcctgggagggtccccaggggccagggcggcggggggaacatttctgggggtgctctcccccaggggcccggccccacagcagc

SEQ ID NO: 11696 - DNA, 156 bp, Homo sapiens
  chr13:100637800-100637956
  hyper
ctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccc

SEQ ID NO: 11697 - DNA, 187 bp, Homo sapiens
  chr13:100640972-100641159
  hyper
tgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccac

SEQ ID NO: 11698 - DNA, 51 bp, Homo sapiens; identical to SEQ ID NO: 1121
  chr13:100642150-100642201
  hyper

SEQ ID NO: 11699 - DNA, 145 bp, Homo sapiens
  chr13:100644025-100644170
  hyper
cagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 11700 - DNA, 32 bp, Homo sapiens
  chr13:100647898-100647930
  hyper
tgctaagcagatctccgcgttaaattagccta

SEQ ID NO: 11701 - DNA, 227 bp, Homo sapiens; identical to SEQ ID NO: 1122
  chr13:100649349-100649576
  hyper

SEQ ID NO: 11702 - DNA, 86 bp, Homo sapiens; identical to SEQ ID NO: 1123
  chr13:100649799-100649885
  hyper

SEQ ID NO: 11703 - DNA, 26 bp, Homo sapiens
  chr13:102069045-102069071
  hyper
gcagttccttcttgccggctgccacc

SEQ ID NO: 11704 - DNA, 62 bp, Homo sapiens
  chr13:102568422-102568484
  hyper
ctgcgagcggtggctcgaccccgggtgtggcaggaaggggtgccccgcgttccagagccagt

SEQ ID NO: 11705 - DNA, 230 bp, Homo sapiens; identical to SEQ ID NO: 1124
  chr13:102569312-102569542
  hyper

SEQ ID NO: 11706 - DNA, 60 bp, Homo sapiens
  chr13:102569830-102569890
  hyper
caactcgctggttcccgagccttccgcggcttggttggggcttctcggtcttaacgtggt

SEQ ID NO: 11707 - DNA, 388 bp, Homo sapiens
  chr13:103046665-103047053
  hyper
cacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggc

SEQ ID NO: 11708 - DNA, 247 bp, Homo sapiens
  chr13:103047054-103047301
  hyper
gcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaa

SEQ ID NO: 11709 - DNA, 30 bp, Homo sapiens
  chr13:103052128-103052158
  hyper
tggggtgaatagaaacggtgtaagaactag

SEQ ID NO: 11710 - DNA, 307 bp, Homo sapiens; identical to SEQ ID NO: 4047
  chr13:103052521-103052828
  hyper

SEQ ID NO: 11711 - DNA, 380 bp, Homo sapiens; identical to SEQ ID NO: 4048
  chr13:103052829-103053209
  hyper

SEQ ID NO: 11712 - DNA, 30 bp, Homo sapiens
  chr13:103054590-103054620
  hyper
agttctcaatcaccacgaagaaaagatgca

SEQ ID NO: 11713 - DNA, 238 bp, Homo sapiens
  chr13:108518605-108518843
  hyper
ggactcccccatgctcgccaggagcgcgggccaggagggctcctgctgccgccgctgctgctgctgctgctgccgctgcctctgctgctgctgctgctgctgctgctgccgctgctgctgctggtgctccttgtcccgggcccgggtcagcttggcctcggcgcagaaccacaagtgatcagagagcaggactgtgaaaaacaagagagatgccagagacagtcgccatttctgagcc

SEQ ID NO: 11714 - DNA, 72 bp, Homo sapiens
  chr13:108519674-108519746
  hyper
ccgctgccgcagggccgcccgcgggcgccgccgccggggctccgactgctgacgccgcctcccgcggagctc

SEQ ID NO: 11715 - DNA, 80 bp, Homo sapiens; identical to SEQ ID NO: 4049
  chr13:109147783-109147863
  hyper

SEQ ID NO: 11716 - DNA, 115 bp, Homo sapiens; identical to SEQ ID NO: 4050
  chr13:109148154-109148269
  hyper

SEQ ID NO: 11717 - DNA, 80 bp, Homo sapiens
  chr13:109148480-109148560
  hyper
ggagaggaggcttgtcggtcccttcctgggaaaggaatcgcggggacttcccaaccgctaggacgcgtaagccgaggctg

SEQ ID NO: 11718 - DNA, 36 bp, Homo sapiens
  chr13:109148973-109149009
  hyper
aattggtccctagtacgcccccgaaaggaaatggag

SEQ ID NO: 11719 - DNA, 250 bp, Homo sapiens
  chr13:110958727-110958977
  hyper
gccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcataccc

SEQ ID NO: 11720 - DNA, 3 bp, Homo sapiens
  chr13:110958978-110958981
  hyper
cga

SEQ ID NO: 11721 - DNA, 132 bp, Homo sapiens; identical to SEQ ID NO: 4051
  chr13:110959517-110959649
  hyper

SEQ ID NO: 11722 - DNA, 275 bp, Homo sapiens; identical to SEQ ID NO: 4052
  chr13:110959752-110960027
  hyper

SEQ ID NO: 11723 - DNA, 158 bp, Homo sapiens
  chr13:110960445-110960603
  hyper
gttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 11724 - DNA, 83 bp, Homo sapiens
  chr13:110960909-110960992
  hyper
ctctgggtaaaggggcggggcgaggaggcgaacgagacaaccttagtattgtttgaattgaagcattgcgagggaacaatggc

SEQ ID NO: 11725 - DNA, 33 bp, Homo sapiens
  chr13:111767955-111767988
  hyper
agggctttctgcaggcgtcgctgaaggatgggg

SEQ ID NO: 11726 - DNA, 176 bp, Homo sapiens; identical to SEQ ID NO: 4053
  chr13:112707743-112707919
  hyper

SEQ ID NO: 11727 - DNA, 206 bp, Homo sapiens; identical to SEQ ID NO: 4054
  chr13:112708307-112708513
  hyper

SEQ ID NO: 11728 - DNA, 117 bp, Homo sapiens
  chr13:112710359-112710476
  hyper
cgcggggaccggcgcgggtgggagtgggggcgcggcgcggaaaaccccagggaaggaccgggtggacacgggacgggaggggggtgacatcctcccacccgggggttagaaaaggtc

SEQ ID NO: 11729 - DNA, 78 bp, Homo sapiens
  chr13:112710745-112710823
  hyper
gaggggactggggagcggcgagaggaggacgggagacgcggctccacctcccagctcaaaacggcgtcccagctgctc

SEQ ID NO: 11730 - DNA, 113 bp, Homo sapiens
  chr13:112710824-112710937
  hyper
caaaccaactgctcgattctattcactgtcgagtaggaacaaaaaagtggctatttattagaatacttgtttggtattgttccgcgccacacaaaaggcgtttcattatgtgg

SEQ ID NO: 11731 - DNA, 86 bp, Homo sapiens
  chr13:112711203-112711289
  hyper
gcgtcgcgctgggcacgctggccacccggtccggaatgagtcggggctccgggaggtgcccgtgggcagagcgttaggggcgcggc

SEQ ID NO: 11732 - DNA, 125 bp, Homo sapiens; identical to SEQ ID NO: 4055
  chr13:112711624-112711749
  hyper

SEQ ID NO: 11733 - DNA, 930 bp, Homo sapiens; identical to SEQ ID NO: 1125
  chr13:112712048-112712978
  hyper

SEQ ID NO: 11734 - DNA, 260 bp, Homo sapiens; identical to SEQ ID NO: 1126
  chr13:112715354-112715614
  hyper

SEQ ID NO: 11735 - DNA, 417 bp, Homo sapiens; identical to SEQ ID NO: 1127
  chr13:112715936-112716353
  hyper

SEQ ID NO: 11736 - DNA, 34 bp, Homo sapiens
  chr13:112716636-112716670
  hyper
acgcgcgcgtgcgcgcgcgcgcacacacacatac

SEQ ID NO: 11737 - DNA, 30 bp, Homo sapiens
  chr13:112717114-112717144
  hyper
tggccatcacccgagcgccctggagcgcca

SEQ ID NO: 11738 - DNA, 443 bp, Homo sapiens
  chr13:112717506-112717949
  hyper
tggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttg

SEQ ID NO: 11739 - DNA, 30 bp, Homo sapiens
  chr13:112720247-112720277
  hyper
cttaggcaaccagctcgtgggaaattcact

SEQ ID NO: 11740 - DNA, 509 bp, Homo sapiens; identical to SEQ ID NO: 4059
  chr13:112720518-112721027
  hyper

SEQ ID NO: 11741 - DNA, 93 bp, Homo sapiens; identical to SEQ ID NO: 4060
  chr13:112722128-112722221
  hyper

SEQ ID NO: 11742 - DNA, 38 bp, Homo sapiens; identical to SEQ ID NO: 4061
  chr13:112722274-112722312
  hyper

SEQ ID NO: 11743 - DNA, 65 bp, Homo sapiens
  chr13:112724425-112724490
  hyper
tcaaggaaacacaatcgctgaaccaaaacgtactgcagccgagccccctccgtccatcctctgcc

SEQ ID NO: 11744 - DNA, 185 bp, Homo sapiens
  chr13:112726435-112726620
  hyper
cgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacc

SEQ ID NO: 11745 - DNA, 157 bp, Homo sapiens
  chr13:112726982-112727139
  hyper
ctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccggg

SEQ ID NO: 11746 - DNA, 361 bp, Homo sapiens; identical to SEQ ID NO: 1128
  chr13:112758012-112758373
  hyper

SEQ ID NO: 11747 - DNA, 196 bp, Homo sapiens; identical to SEQ ID NO: 1129
  chr13:112758495-112758691
  hyper

SEQ ID NO: 11748 - DNA, 205 bp, Homo sapiens; identical to SEQ ID NO: 4064
  chr13:112759202-112759407
  hyper

SEQ ID NO: 11749 - DNA, 70 bp, Homo sapiens
  chr13:112759612-112759682
  hyper
aattgtctattttctcgccaacagtctccatcacaatcacttatctggaaacctgcggttggattaatcg

SEQ ID NO: 11750 - DNA, 68 bp, Homo sapiens
  chr13:112760259-112760327
  hyper
cccagttctgcaggccgctccagggctaggggtagagatggtggcaggtggtgcgtcaactctctagg

SEQ ID NO: 11751 - DNA, 348 bp, Homo sapiens; identical to SEQ ID NO: 1130
  chr13:112760850-112761198
  hyper

SEQ ID NO: 11752 - DNA, 30 bp, Homo sapiens
  chr13:113547121-113547151
  hyper
tggagccactccctgcgggtctgagtgggg

SEQ ID NO: 11753 - DNA, 51 bp, Homo sapiens
  chr13:114462901-114462952
  hyper
acaggaaacctgttgcgtgttcaccagttcgcaagccgggctcgggggctc

SEQ ID NO: 11754 - DNA, 44 bp, Homo sapiens
  chr14:21093506-21093550
  hyper
tgcaaactcctataacgtgtgtggtagtgtggccgagcggtcta

SEQ ID NO: 11755 - DNA, 103 bp, Homo sapiens
  chr14:21093610-21093713
  hyper
gtggtacgttttagcacaacaaggatcctgaagtactaacactttctaactagtaaaataattaaatcttcctttcccaggattctcccggattacacagcat

SEQ ID NO: 11756 - DNA, 165 bp, Homo sapiens
  chr14:21100842-21101007
  hyper
gtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 11757 - DNA, 3 bp, Homo sapiens
  chr14:21101008-21101011
  hyper
gaa

SEQ ID NO: 11758 - DNA, 19 bp, Homo sapiens
  chr14:21101037-21101056
  hyper
cgcacgttgactttcctgg

SEQ ID NO: 11759 - DNA, 30 bp, Homo sapiens
  chr14:21121400-21121430
  hyper
ccttgcaactctagtcgtccaataagcttt

SEQ ID NO: 11760 - DNA, 15 bp, Homo sapiens
  chr14:21121902-21121917
  hyper
ctcatcccccacccc

SEQ ID NO: 11761 - DNA, 44 bp, Homo sapiens
  chr14:21769210-21769254
  hyper
ggcgcgggcagaaggcgggatggcggcagcgcctctccatgcac

SEQ ID NO: 11762 - DNA, 30 bp, Homo sapiens
  chr14:23291877-23291907
  hyper
agacaggagtctgggcgagcgccccaaccc

SEQ ID NO: 11763 - DNA, 112 bp, Homo sapiens
  chr14:23821464-23821576
  hyper
gctgcagctgctggccgccgcccagcgcccccacctgggcgagcagcgcctcaaagctgagggggcctgggggcacggccagcgacaggctgctgcccagtccgtcgccgcc

SEQ ID NO: 11764 - DNA, 21 bp, Homo sapiens
  chr14:23821601-23821622
  hyper
cgctcccgctcaccctgcagc

SEQ ID NO: 11765 - DNA, 323 bp, Homo sapiens; identical to SEQ ID NO: 1131
  chr14:24803594-24803917
  hyper

SEQ ID NO: 11766 - DNA, 205 bp, Homo sapiens; identical to SEQ ID NO: 1132
  chr14:24803918-24804123
  hyper

SEQ ID NO: 11767 - DNA, 23 bp, Homo sapiens
  chr14:24804424-24804447
  hyper
cgcctccccgcttcagccccttc

SEQ ID NO: 11768 - DNA, 190 bp, Homo sapiens
  chr14:25518450-25518640
  hyper
cgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtga

SEQ ID NO: 11769 - DNA, 223 bp, Homo sapiens; identical to SEQ ID NO: 4069
  chr14:26674354-26674577
  hyper

SEQ ID NO: 11770 - DNA, 30 bp, Homo sapiens
  chr14:27066218-27066248
  hyper
ggtcaacctctggaccgattaaatggaaag

SEQ ID NO: 11771 - DNA, 30 bp, Homo sapiens
  chr14:27066651-27066681
  hyper
tcctgccgctgctaccgggagaaggttctc

SEQ ID NO: 11772 - DNA, 60 bp, Homo sapiens
  chr14:27067097-27067157
  hyper
gaaggaggtggatgccgagagaggagcgagcggcagaggagggcaggagccgggaaggag

SEQ ID NO: 11773 - DNA, 44 bp, Homo sapiens
  chr14:27067635-27067679
  hyper
cacggctcaggcaaacgtaagcggcttgtcgcagaaaccaaggg

SEQ ID NO: 11774 - DNA, 30 bp, Homo sapiens
  chr14:29225698-29225728
  hyper
ttgagaggatgagctcgagattgaagagtg

SEQ ID NO: 11775 - DNA, 82 bp, Homo sapiens; identical to SEQ ID NO: 4070
  chr14:29226033-29226115
  hyper

SEQ ID NO: 11776 - DNA, 43 bp, Homo sapiens
  chr14:29226360-29226403
  hyper
aagaaaatattgtgacgatgttgtagggcgaaaggggacgtga

SEQ ID NO: 11777 - DNA, 30 bp, Homo sapiens
  chr14:29227895-29227925
  hyper
cttctgcagccctggcgtggatatgcacgt

SEQ ID NO: 11778 - DNA, 151 bp, Homo sapiens
  chr14:29228268-29228419
  hyper
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggag

SEQ ID NO: 11779 - DNA, 356 bp, Homo sapiens; identical to SEQ ID NO: 4071
  chr14:29228628-29228984
  hyper

SEQ ID NO: 11780 - DNA, 16 bp, Homo sapiens
  chr14:29229233-29229249
  hyper
catctagagagatgac

SEQ ID NO: 11781 - DNA, 136 bp, Homo sapiens
  chr14:29229250-29229386
  hyper
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaag

SEQ ID NO: 11782 - DNA, 30 bp, Homo sapiens
  chr14:29230911-29230941
  hyper
tggaacacctggcagcgtcacagagacttg

SEQ ID NO: 11783 - DNA, 38 bp, Homo sapiens
  chr14:29231293-29231331
  hyper
gacgttgagggtgcgcgtgcgcgcgctgagagcagcca

SEQ ID NO: 11784 - DNA, 439 bp, Homo sapiens; identical to SEQ ID NO: 1134
  chr14:29234853-29235292
  hyper

SEQ ID NO: 11785 - DNA, 61 bp, Homo sapiens
  chr14:29236023-29236084
  hyper
tccccagcctcgccgcggccgctccgggacgcgcccgcccgccgcccggctctccccccct

SEQ ID NO: 11786 - DNA, 89 bp, Homo sapiens
  chr14:29236672-29236761
  hyper
cgcaaccgccgccgccgccgcagcagcagcagccgccgccgccgccgcccccggcaccgcagcccccccagacgcggggcgccccggcc

SEQ ID NO: 11787 - DNA, 4 bp, Homo sapiens
  chr14:29237063-29237067
  hyper
catc

SEQ ID NO: 11788 - DNA, 63 bp, Homo sapiens
  chr14:29243208-29243271
  hyper
ccggtcggatttagccgggctgctccgggtcgggtgaggcactgggtgcgtgtgggagtcttc

SEQ ID NO: 11789 - DNA, 30 bp, Homo sapiens
  chr14:29243530-29243560
  hyper
gcgcctcagggactccggggtgaagatgga

SEQ ID NO: 11790 - DNA, 231 bp, Homo sapiens
  chr14:29243856-29244087
  hyper
cagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccat

SEQ ID NO: 11791 - DNA, 163 bp, Homo sapiens
  chr14:29247187-29247350
  hyper
cagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtagg

SEQ ID NO: 11792 - DNA, 15 bp, Homo sapiens
  chr14:29254425-29254440
  hyper
ggcgcccgcagaagc

SEQ ID NO: 11793 - DNA, 32 bp, Homo sapiens; identical to SEQ ID NO: 4074
  chr14:29254611-29254643
  hyper

SEQ ID NO: 11794 - DNA, 137 bp, Homo sapiens
  chr14:31343407-31343544
  hyper
gggtggggcgggtagcggccgccgctgcctcagcagccctggtcccggcagagcagggctggcgaggccgctgctgccgccgtcggggccgccggccctccacactcgttgagacgccggcacggggaccttcgtgc

SEQ ID NO: 11795 - DNA, 234 bp, Homo sapiens
  chr14:31344315-31344549
  hyper
gggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagca

SEQ ID NO: 11796 - DNA, 90 bp, Homo sapiens
  chr14:33402367-33402457
  hyper
cggcctgtgtcactcttggccttggcaacttctggccaatccgccctgcccctctgggtcccggcgggccggctgcgccctaggctcaaa

SEQ ID NO: 11797 - DNA, 92 bp, Homo sapiens
  chr14:33402751-33402843
  hyper
actccactccaggctcgccagccggaagaaagaggaggaagtgggacaacgggggtcctgggcaggggtaggggaaacgatcaactcccact

SEQ ID NO: 11798 - DNA, 62 bp, Homo sapiens
  chr14:33403270-33403332
  hyper
taagtatcaagttctcgaggagcccaacttgcgcttggcagccctcgcgctgcctgatgtgc

SEQ ID NO: 11799 - DNA, 30 bp, Homo sapiens
  chr14:33403549-33403579
  hyper
gtgtgtagaggggggcgggaaagaaacgca

SEQ ID NO: 11800 - DNA, 55 bp, Homo sapiens
  chr14:33403846-33403901
  hyper
ccccagcccgctgcgcgcacatcaaagctcctctccgccgcgcacagtggccgcg

SEQ ID NO: 11801 - DNA, 254 bp, Homo sapiens
  chr14:33404164-33404418
  hyper
cggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 11802 - DNA, 655 bp, Homo sapiens; identical to SEQ ID NO: 4075
  chr14:36004080-36004735
  hyper

SEQ ID NO: 11803 - DNA, 101 bp, Homo sapiens; identical to SEQ ID NO: 4076
  chr14:36004821-36004922
  hyper

SEQ ID NO: 11804 - DNA, 83 bp, Homo sapiens
  chr14:36972706-36972789
  hyper
ctgactttattcttacggaattaaacacaataatttttttaaaatatcttctttgaggcaagtgaccacgagagcacctgtta

SEQ ID NO: 11805 - DNA, 84 bp, Homo sapiens; identical to SEQ ID NO: 1135
  chr14:36973454-36973538
  hyper

SEQ ID NO: 11806 - DNA, 230 bp, Homo sapiens; identical to SEQ ID NO: 4078
  chr14:36974533-36974763
  hyper

SEQ ID NO: 11807 - DNA, 46 bp, Homo sapiens
  chr14:36975034-36975080
  hyper
ataaaagggaggacccggattccaagcccctcgaagtccccaagca

SEQ ID NO: 11808 - DNA, 102 bp, Homo sapiens
  chr14:36975355-36975457
  hyper
cccaggcagctggggcgccctccaagtgacgcctttgtccaggctgcgctcgcggagaataaagggggcgctgtccaacctcaggttcggggaaaaccaagg

SEQ ID NO: 11809 - DNA, 427 bp, Homo sapiens; identical to SEQ ID NO: 4079
  chr14:36977503-36977930
  hyper

SEQ ID NO: 11810 - DNA, 30 bp, Homo sapiens
  chr14:36983330-36983360
  hyper
ttccaagcacctcagcgccaggggcatcct

SEQ ID NO: 11811 - DNA, 438 bp, Homo sapiens; identical to SEQ ID NO: 4080
  chr14:36983708-36984146
  hyper

SEQ ID NO: 11812 - DNA, 30 bp, Homo sapiens
  chr14:36985841-36985871
  hyper
tccaacttttgacagcgttttacagctaca

SEQ ID NO: 11813 - DNA, 171 bp, Homo sapiens; identical to SEQ ID NO: 1136
  chr14:36986301-36986472
  hyper

SEQ ID NO: 11814 - DNA, 249 bp, Homo sapiens; identical to SEQ ID NO: 1137
  chr14:36987301-36987550
  hyper

SEQ ID NO: 11815 - DNA, 172 bp, Homo sapiens; identical to SEQ ID NO: 4083
  chr14:36987960-36988132
  hyper

SEQ ID NO: 11816 - DNA, 437 bp, Homo sapiens
  chr14:36989763-36990200
  hyper
ggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgac

SEQ ID NO: 11817 - DNA, 41 bp, Homo sapiens
  chr14:36990493-36990534
  hyper
ttttagtctcctctgcgcgccaggggctgggagggcggagc

SEQ ID NO: 11818 - DNA, 30 bp, Homo sapiens
  chr14:36990535-36990565
  hyper
ctccccggccggccccggcaggtgcctcca

SEQ ID NO: 11819 - DNA, 175 bp, Homo sapiens; identical to SEQ ID NO: 1138
  chr14:36990858-36991033
  hyper

SEQ ID NO: 11820 - DNA, 92 bp, Homo sapiens; identical to SEQ ID NO: 1139
  chr14:36991094-36991186
  hyper

SEQ ID NO: 11821 - DNA, 178 bp, Homo sapiens; identical to SEQ ID NO: 1140
  chr14:36991600-36991778
  hyper

SEQ ID NO: 11822 - DNA, 37 bp, Homo sapiens; identical to SEQ ID NO: 1141
  chr14:36991988-36992025
  hyper

SEQ ID NO: 11823 - DNA, 170 bp, Homo sapiens
  chr14:36992232-36992402
  hyper
cgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctc

SEQ ID NO: 11824 - DNA, 50 bp, Homo sapiens
  chr14:36993438-36993488
  hyper
cccctcagttgctcccgcagtctcccacagctaggcacaggcttctaagc

SEQ ID NO: 11825 - DNA, 141 bp, Homo sapiens; identical to SEQ ID NO: 4088
  chr14:36993815-36993956
  hyper

SEQ ID NO: 11826 - DNA, 643 bp, Homo sapiens; identical to SEQ ID NO: 4089
  chr14:36994366-36995009
  hyper

SEQ ID NO: 11827 - DNA, 40 bp, Homo sapiens; identical to SEQ ID NO: 4090
  chr14:36995010-36995050
  hyper

SEQ ID NO: 11828 - DNA, 190 bp, Homo sapiens; identical to SEQ ID NO: 4091
  chr14:37116105-37116295
  hyper

SEQ ID NO: 11829 - DNA, 387 bp, Homo sapiens
  chr14:37116983-37117370
  hyper
gtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggc

SEQ ID NO: 11830 - DNA, 453 bp, Homo sapiens; identical to SEQ ID NO: 1142
  chr14:37123566-37124019
  hyper

SEQ ID NO: 11831 - DNA, 91 bp, Homo sapiens; identical to SEQ ID NO: 1143
  chr14:37124481-37124572
  hyper

SEQ ID NO: 11832 - DNA, 30 bp, Homo sapiens; identical to SEQ ID NO: 4094
  chr14:37124992-37125022
  hyper

SEQ ID NO: 11833 - DNA, 420 bp, Homo sapiens; identical to SEQ ID NO: 4095
  chr14:37125232-37125652
  hyper

SEQ ID NO: 11834 - DNA, 173 bp, Homo sapiens; identical to SEQ ID NO: 4096
  chr14:37126156-37126329
  hyper

SEQ ID NO: 11835 - DNA, 63 bp, Homo sapiens
  chr14:37126548-37126611
  hyper
gaaaacttccaaatgcgcgaataccagcaatcccgctcgccttcaacgcgtggggtaaggggg

SEQ ID NO: 11836 - DNA, 169 bp, Homo sapiens
  chr14:37126964-37127133
  hyper
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcc

SEQ ID NO: 11837 - DNA, 243 bp, Homo sapiens
  chr14:37127537-37127780
  hyper
cgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggt

SEQ ID NO: 11838 - DNA, 183 bp, Homo sapiens
  chr14:37130077-37130260
  hyper
cagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcc

SEQ ID NO: 11839 - DNA, 30 bp, Homo sapiens
  chr14:37130494-37130524
  hyper
cccccacctgtggctcgggctccccgcaac

SEQ ID NO: 11840 - DNA, 264 bp, Homo sapiens; identical to SEQ ID NO: 1144
  chr14:37132290-37132554
  hyper

SEQ ID NO: 11841 - DNA, 33 bp, Homo sapiens; identical to SEQ ID NO: 1145
  chr14:37132602-37132635
  hyper

SEQ ID NO: 11842 - DNA, 273 bp, Homo sapiens
  chr14:37132838-37133111
  hyper
tttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttgggg

SEQ ID NO: 11843 - DNA, 67 bp, Homo sapiens; identical to SEQ ID NO: 4099
  chr14:37136294-37136361
  hyper

SEQ ID NO: 11844 - DNA, 30 bp, Homo sapiens
  chr14:37136588-37136618
  hyper
gtctaaattcatcaccgtcctggagtcaag

SEQ ID NO: 11845 - DNA, 30 bp, Homo sapiens
  chr14:38052911-38052941
  hyper
atgctgagagccctgcgtgctcagccaggg

SEQ ID NO: 11846 - DNA, 30 bp, Homo sapiens
  chr14:38057303-38057333
  hyper
gtctccgcactccctcggaaccacagatgt

SEQ ID NO: 11847 - DNA, 45 bp, Homo sapiens
  chr14:38060677-38060722
  hyper
caggctggcgggcaacgtagagccgtaaggcgagtattgcagtgc

SEQ ID NO: 11848 - DNA, 34 bp, Homo sapiens
  chr14:38724294-38724328
  hyper
ggttgcagtggccggcgggcgcctggtgggcacc

SEQ ID NO: 11849 - DNA, 382 bp, Homo sapiens; identical to SEQ ID NO: 1146
  chr14:38724978-38725360
  hyper

SEQ ID NO: 11850 - DNA, 183 bp, Homo sapiens
  chr14:42075097-42075280
  hyper
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcat

SEQ ID NO: 11851 - DNA, 236 bp, Homo sapiens; identical to SEQ ID NO: 4101
  chr14:42075538-42075774
  hyper

SEQ ID NO: 11852 - DNA, 164 bp, Homo sapiens; identical to SEQ ID NO: 4102
  chr14:42076803-42076967
  hyper

SEQ ID NO: 11853 - DNA, 30 bp, Homo sapiens
  chr14:42077230-42077260
  hyper
ccagctcttgaattacgtggattcgggttg

SEQ ID NO: 11854 - DNA, 366 bp, Homo sapiens
  chr14:42079062-42079428
  hyper
tgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtgg

SEQ ID NO: 11855 - DNA, 102 bp, Homo sapiens
  chr14:48143617-48143719
  hyper
cgccgggaggggccccggaacggcgcgagtcgtgcattttcgctcaccagcctatcttgcctaagaatcacaaggtcacgatagcgtcgcgattccactcac

SEQ ID NO: 11856 - DNA, 37 bp, Homo sapiens; identical to SEQ ID NO: 4103
  chr14:48144727-48144764
  hyper

SEQ ID NO: 11857 - DNA, 126 bp, Homo sapiens; identical to SEQ ID NO: 4104
  chr14:48145236-48145362
  hyper

SEQ ID NO: 11858 - DNA, 197 bp, Homo sapiens; identical to SEQ ID NO: 4105
  chr14:48145469-48145666
  hyper

SEQ ID NO: 11859 - DNA, 51 bp, Homo sapiens
  chr14:51410612-51410663
  hyper
ggcggtttccaggggcggacggcacagtggtttgggcgggacactggcggg

SEQ ID NO: 11860 - DNA, 385 bp, Homo sapiens; identical to SEQ ID NO: 1147
  chr14:51560329-51560714
  hyper

SEQ ID NO: 11861 - DNA, 523 bp, Homo sapiens; identical to SEQ ID NO: 1148
  chr14:51560770-51561293
  hyper

SEQ ID NO: 11862 - DNA, 226 bp, Homo sapiens; identical to SEQ ID NO: 1149
  chr14:51561294-51561520
  hyper

SEQ ID NO: 11863 - DNA, 74 bp, Homo sapiens
  chr14:51562419-51562493
  hyper
ccgggagtctgacggcgctggcgcaagccctggcgacactcttggcttctttcatcctgcgtccctcgtttcct

SEQ ID NO: 11864 - DNA, 379 bp, Homo sapiens; identical to SEQ ID NO: 1150
  chr14:52534648-52535027
  hyper

SEQ ID NO: 11865 - DNA, 209 bp, Homo sapiens; identical to SEQ ID NO: 1151
  chr14:52535055-52535264
  hyper

SEQ ID NO: 11866 - DNA, 91 bp, Homo sapiens; identical to SEQ ID NO: 1152
  chr14:52535334-52535425
  hyper

SEQ ID NO: 11867 - DNA, 332 bp, Homo sapiens; identical to SEQ ID NO: 1153
  chr14:52535426-52535758
  hyper

SEQ ID NO: 11868 - DNA, 214 bp, Homo sapiens; identical to SEQ ID NO: 1154
  chr14:52535759-52535973
  hyper

SEQ ID NO: 11869 - DNA, 92 bp, Homo sapiens; identical to SEQ ID NO: 1155
  chr14:52535974-52536066
  hyper

SEQ ID NO: 11870 - DNA, 38 bp, Homo sapiens; identical to SEQ ID NO: 1156
  chr14:52536067-52536105
  hyper

SEQ ID NO: 11871 - DNA, 50 bp, Homo sapiens; identical to SEQ ID NO: 1157
  chr14:52536342-52536392
  hyper

SEQ ID NO: 11872 - DNA, 332 bp, Homo sapiens; identical to SEQ ID NO: 4117
  chr14:52781525-52781857
  hyper

SEQ ID NO: 11873 - DNA, 494 bp, Homo sapiens
  chr14:54422431-54422925
  hyper
aagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtcc

SEQ ID NO: 11874 - DNA, 34 bp, Homo sapiens
  chr14:54422926-54422960
  hyper
gggatcgcaacctccagcccgtgggcaacgcgtt

SEQ ID NO: 11875 - DNA, 260 bp, Homo sapiens
  chr14:54430156-54430416
  hyper
atgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgc

SEQ ID NO: 11876 - DNA, 220 bp, Homo sapiens; identical to SEQ ID NO: 1158
  chr14:57260875-57261095
  hyper

SEQ ID NO: 11877 - DNA, 234 bp, Homo sapiens; identical to SEQ ID NO: 1159
  chr14:57261174-57261408
  hyper

SEQ ID NO: 11878 - DNA, 382 bp, Homo sapiens; identical to SEQ ID NO: 1160
  chr14:57261465-57261847
  hyper

SEQ ID NO: 11879 - DNA, 64 bp, Homo sapiens
  chr14:57262072-57262136
  hyper
agggtcattggccagcgacccgccctccttacgtccggaggtcaccccacgcctacaggcaggt

SEQ ID NO: 11880 - DNA, 30 bp, Homo sapiens
  chr14:57263831-57263861
  hyper
tatcagagcaccctgcgctgacaggctcgg

SEQ ID NO: 11881 - DNA, 567 bp, Homo sapiens; identical to SEQ ID NO: 1161
  chr14:57264079-57264646
  hyper

SEQ ID NO: 11882 - DNA, 43 bp, Homo sapiens; identical to SEQ ID NO: 1162
  chr14:57264764-57264807
  hyper

SEQ ID NO: 11883 - DNA, 93 bp, Homo sapiens; identical to SEQ ID NO: 1163
  chr14:57265147-57265240
  hyper

SEQ ID NO: 11884 - DNA, 57 bp, Homo sapiens
  chr14:57265517-57265574
  hyper
gccccagcctcccagcgtcttgcgcctgtggcggcggcagtacgggcctggggggtc

SEQ ID NO: 11885 - DNA, 15 bp, Homo sapiens
  chr14:57270957-57270972
  hyper
aagatgtctgggtac

SEQ ID NO: 11886 - DNA, 28 bp, Homo sapiens
  chr14:57271153-57271181
  hyper
cgcagcagtcccccgttcctcacagccc

SEQ ID NO: 11887 - DNA, 58 bp, Homo sapiens; identical to SEQ ID NO: 4126
  chr14:57272009-57272067
  hyper

SEQ ID NO: 11888 - DNA, 30 bp, Homo sapiens
  chr14:57273051-57273081
  hyper
tatgtgtctaaggaacgaaagctaaacaaa

SEQ ID NO: 11889 - DNA, 322 bp, Homo sapiens; identical to SEQ ID NO: 1166
  chr14:57274417-57274739
  hyper

SEQ ID NO: 11890 - DNA, 310 bp, Homo sapiens; identical to SEQ ID NO: 1167
  chr14:57274740-57275050
  hyper

SEQ ID NO: 11891 - DNA, 17 bp, Homo sapiens
  chr14:57275210-57275227
  hyper
cgcgagggagggaggaa

SEQ ID NO: 11892 - DNA, 201 bp, Homo sapiens; identical to SEQ ID NO: 4130
  chr14:57275485-57275686
  hyper

SEQ ID NO: 11893 - DNA, 593 bp, Homo sapiens; identical to SEQ ID NO: 4131
  chr14:57276073-57276666
  hyper

SEQ ID NO: 11894 - DNA, 417 bp, Homo sapiens; identical to SEQ ID NO: 1169
  chr14:57277979-57278396
  hyper

SEQ ID NO: 11895 - DNA, 69 bp, Homo sapiens; identical to SEQ ID NO: 1170
  chr14:57278694-57278763
  hyper

SEQ ID NO: 11896 - DNA, 728 bp, Homo sapiens; identical to SEQ ID NO: 1171
  chr14:57278837-57279565
  hyper

SEQ ID NO: 11897 - DNA, 30 bp, Homo sapiens
  chr14:57281138-57281168
  hyper
tcactccctgcattgcggttgcctcaaaaa

SEQ ID NO: 11898 - DNA, 110 bp, Homo sapiens; identical to SEQ ID NO: 1172
  chr14:57283299-57283409
  hyper

SEQ ID NO: 11899 - DNA, 592 bp, Homo sapiens; identical to SEQ ID NO: 1173
  chr14:57283445-57284037
  hyper

SEQ ID NO: 11900 - DNA, 541 bp, Homo sapiens; identical to SEQ ID NO: 1174
  chr14:57284070-57284611
  hyper

SEQ ID NO: 11901 - DNA, 128 bp, Homo sapiens
  chr14:58332254-58332382
  hyper
cagcaccgaggacagcggacatacttttctccccggggggtccccgccgccaggaaggcggtgttgacagcgtccgcagggctgcaggtgtccgtaccgcgcgcccgcccgtccgcatccccgcggca

SEQ ID NO: 11902 - DNA, 68 bp, Homo sapiens
  chr14:58332640-58332708
  hyper
tgcagctcctgctcccgcgcccgggctctgactccaccgcccggcgcagcaccggctccgcatcacag

SEQ ID NO: 11903 - DNA, 30 bp, Homo sapiens
  chr14:60043273-60043303
  hyper
tgagtgcctcctaagcgccacctctgagga

SEQ ID NO: 11904 - DNA, 54 bp, Homo sapiens
  chr14:60097193-60097247
  hyper
ccatcttggtggaatcggcagtggcctgcatcgtgcgggctttgggggctcgcc

SEQ ID NO: 11905 - DNA, 204 bp, Homo sapiens
  chr14:60097406-60097610
  hyper
ggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagag

SEQ ID NO: 11906 - DNA, 42 bp, Homo sapiens
  chr14:60336952-60336994
  hyper
gcgaatattcccagtcgcccgtggcgacgcgggggtggggtc

SEQ ID NO: 11907 - DNA, 48 bp, Homo sapiens
  chr14:60386671-60386719
  hyper
ccaggtggggtcttccggttggacccctgcttccgctgattggttgga

SEQ ID NO: 11908 - DNA, 330 bp, Homo sapiens; identical to SEQ ID NO: 4138
  chr14:60794473-60794803
  hyper

SEQ ID NO: 11909 - DNA, 225 bp, Homo sapiens; identical to SEQ ID NO: 1175
  chr14:60952195-60952420
  hyper

SEQ ID NO: 11910 - DNA, 117 bp, Homo sapiens; identical to SEQ ID NO: 1176
  chr14:60952516-60952633
  hyper

SEQ ID NO: 11911 - DNA, 218 bp, Homo sapiens; identical to SEQ ID NO: 1177
  chr14:60952729-60952947
  hyper

SEQ ID NO: 11912 - DNA, 311 bp, Homo sapiens; identical to SEQ ID NO: 1178
  chr14:60973697-60974008
  hyper

SEQ ID NO: 11913 - DNA, 35 bp, Homo sapiens
  chr14:60974368-60974403
  hyper
tgccctgcactcaggcgtggcgtgatctgacccga

SEQ ID NO: 11914 - DNA, 441 bp, Homo sapiens; identical to SEQ ID NO: 1179
  chr14:60975448-60975889
  hyper

SEQ ID NO: 11915 - DNA, 440 bp, Homo sapiens; identical to SEQ ID NO: 1180
  chr14:60976074-60976514
  hyper

SEQ ID NO: 11916 - DNA, 279 bp, Homo sapiens; identical to SEQ ID NO: 4145
  chr14:60977434-60977713
  hyper

SEQ ID NO: 11917 - DNA, 285 bp, Homo sapiens; identical to SEQ ID NO: 4146
  chr14:60977879-60978164
  hyper

SEQ ID NO: 11918 - DNA, 567 bp, Homo sapiens; identical to SEQ ID NO: 4147
  chr14:60981226-60981793
  hyper

SEQ ID NO: 11919 - DNA, 258 bp, Homo sapiens; identical to SEQ ID NO: 1181
  chr14:60982110-60982368
  hyper

SEQ ID NO: 11920 - DNA, 42 bp, Homo sapiens
  chr14:60982909-60982951
  hyper
gaacaagcagtttcacgcctccctgcccgctcatgctgtttc

SEQ ID NO: 11921 - DNA, 316 bp, Homo sapiens; identical to SEQ ID NO: 1182
  chr14:61104241-61104557
  hyper

SEQ ID NO: 11922 - DNA, 241 bp, Homo sapiens; identical to SEQ ID NO: 1183
  chr14:61104623-61104864
  hyper

SEQ ID NO: 11923 - DNA, 32 bp, Homo sapiens
  chr14:61109438-61109470
  hyper
ggcgcccgagcttcccgcgcctctccagggcc

SEQ ID NO: 11924 - DNA, 515 bp, Homo sapiens
  chr14:61109728-61110243
  hyper
ctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgt

SEQ ID NO: 11925 - DNA, 289 bp, Homo sapiens
  chr14:61114424-61114713
  hyper
caaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgagga

SEQ ID NO: 11926 - DNA, 358 bp, Homo sapiens
  chr14:61114997-61115355
  hyper
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttcctt

SEQ ID NO: 11927 - DNA, 122 bp, Homo sapiens
  chr14:61115927-61116049
  hyper
cacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 11928 - DNA, 30 bp, Homo sapiens
  chr14:61116998-61117028
  hyper
tatcttaatgttctgcgattgaaaccagca

SEQ ID NO: 11929 - DNA, 30 bp, Homo sapiens
  chr14:61655802-61655832
  hyper
gacgatctgctccttcggaagaaaacacag

SEQ ID NO: 11930 - DNA, 73 bp, Homo sapiens
  chr14:61788757-61788830
  hyper
gactcccggttctcccgctgcgaagcagcgcggccccccggggccggggcagcggcgccggcatgtcgtctgg

SEQ ID NO: 11931 - DNA, 154 bp, Homo sapiens; identical to SEQ ID NO: 4151
  chr14:62279322-62279476
  hyper

SEQ ID NO: 11932 - DNA, 104 bp, Homo sapiens; identical to SEQ ID NO: 4152
  chr14:62279519-62279623
  hyper

SEQ ID NO: 11933 - DNA, 229 bp, Homo sapiens; identical to SEQ ID NO: 4153
  chr14:62279624-62279853
  hyper

SEQ ID NO: 11934 - DNA, 15 bp, Homo sapiens
  chr14:62279898-62279913
  hyper
cgagttctgggtcgg

SEQ ID NO: 11935 - DNA, 120 bp, Homo sapiens
  chr14:62583750-62583870
  hyper
agccaaggcctgcagcgagtgacctgcccggggaggcgcgggaccgaggctcacctacccgggcccgcgagtctcgcccagccccagcctcccaacccactctgccggccccaacttagg

SEQ ID NO: 11936 - DNA, 348 bp, Homo sapiens
  chr14:62583918-62584266
  hyper
cggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaaca

SEQ ID NO: 11937 - DNA, 124 bp, Homo sapiens; identical to SEQ ID NO: 4155
  chr14:63511883-63512007
  hyper

SEQ ID NO: 11938 - DNA, 646 bp, Homo sapiens; identical to SEQ ID NO: 4156
  chr14:63512063-63512709
  hyper

SEQ ID NO: 11939 - DNA, 81 bp, Homo sapiens; identical to SEQ ID NO: 4157
  chr14:63512740-63512821
  hyper

SEQ ID NO: 11940 - DNA, 73 bp, Homo sapiens; identical to SEQ ID NO: 4158
  chr14:63513035-63513108
  hyper

SEQ ID NO: 11941 - DNA, 66 bp, Homo sapiens
  chr14:64761073-64761139
  hyper
tgaaaagatcacaagcgacttaacgataagccccttcttccttttaaagaccgagaggagggtaga

SEQ ID NO: 11942 - DNA, 15 bp, Homo sapiens
  chr14:65007522-65007537
  hyper
tctccctggttttcc

SEQ ID NO: 11943 - DNA, 15 bp, Homo sapiens
  chr14:65007552-65007567
  hyper
cgcctttcagtcagg

SEQ ID NO: 11944 - DNA, 203 bp, Homo sapiens
  chr14:65008997-65009200
  hyper
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccc

SEQ ID NO: 11945 - DNA, 282 bp, Homo sapiens
  chr14:69726381-69726663
  hyper
ccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaa

SEQ ID NO: 11946 - DNA, 34 bp, Homo sapiens
  chr14:69727831-69727865
  hyper
ggtgggcagtgtcagcgcccgaacttggcgatac

SEQ ID NO: 11947 - DNA, 246 bp, Homo sapiens; identical to SEQ ID NO: 4159
  chr14:70014699-70014945
  hyper

SEQ ID NO: 11948 - DNA, 510 bp, Homo sapiens
  chr14:70346020-70346530
  hyper
cacctgccagagggtcggcttcaacaggcctcttggcccgtcaatcaggcccgccgtgctccgccccgcccctcccgggggtttataacgggaattcccatggcccgggctcaggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccagggtaagtgcgcccccagctttgcgcccacctgcggag

SEQ ID NO: 11949 - DNA, 66 bp, Homo sapiens
  chr14:70653713-70653779
  hyper
cgggtcgccaggggccgaggaggcttcccttttggtgccccaccggaaggccggatgtgttcctat

SEQ ID NO: 11950 - DNA, 220 bp, Homo sapiens; identical to SEQ ID NO: 1184
  chr14:70654070-70654290
  hyper

SEQ ID NO: 11951 - DNA, 306 bp, Homo sapiens; identical to SEQ ID NO: 1185
  chr14:70654291-70654597
  hyper

SEQ ID NO: 11952 - DNA, 41 bp, Homo sapiens; identical to SEQ ID NO: 1186
  chr14:70654598-70654639
  hyper

SEQ ID NO: 11953 - DNA, 147 bp, Homo sapiens; identical to SEQ ID NO: 1187
  chr14:70654640-70654787
  hyper

SEQ ID NO: 11954 - DNA, 858 bp, Homo sapiens; identical to SEQ ID NO: 4164
  chr14:70655032-70655890
  hyper

SEQ ID NO: 11955 - DNA, 171 bp, Homo sapiens; identical to SEQ ID NO: 4165
  chr14:70655919-70656090
  hyper

SEQ ID NO: 11956 - DNA, 547 bp, Homo sapiens; identical to SEQ ID NO: 4166
  chr14:72398686-72399233
  hyper

SEQ ID NO: 11957 - DNA, 2 bp, Homo sapiens
  chr14:72399451-72399453
  hyper
cg

SEQ ID NO: 11958 - DNA, 88 bp, Homo sapiens; identical to SEQ ID NO: 4168
  chr14:72399929-72400017
  hyper

SEQ ID NO: 11959 - DNA, 61 bp, Homo sapiens
  chr14:74208236-74208297
  hyper
accagccagcagcagcggagggcagggctgggcgggcacagggtcccgactatacccagtt

SEQ ID NO: 11960 - DNA, 351 bp, Homo sapiens; identical to SEQ ID NO: 1188
  chr14:74706046-74706397
  hyper

SEQ ID NO: 11961 - DNA, 605 bp, Homo sapiens; identical to SEQ ID NO: 1189
  chr14:74706940-74707545
  hyper

SEQ ID NO: 11962 - DNA, 176 bp, Homo sapiens; identical to SEQ ID NO: 1190
  chr14:74707572-74707748
  hyper

SEQ ID NO: 11963 - DNA, 120 bp, Homo sapiens; identical to SEQ ID NO: 1191
  chr14:74707791-74707911
  hyper

SEQ ID NO: 11964 - DNA, 418 bp, Homo sapiens; identical to SEQ ID NO: 1192
  chr14:74707912-74708330
  hyper

SEQ ID NO: 11965 - DNA, 174 bp, Homo sapiens; identical to SEQ ID NO: 4174
  chr14:74708862-74709036
  hyper

SEQ ID NO: 11966 - DNA, 32 bp, Homo sapiens
  chr14:74893081-74893113
  hyper
cggcgaagcgaggggcgcgcagctggaacccg

SEQ ID NO: 11967 - DNA, 30 bp, Homo sapiens
  chr14:75077906-75077936
  hyper
ttaacgtcggggctccgggagagttggtaa

SEQ ID NO: 11968 - DNA, 185 bp, Homo sapiens
  chr14:75078651-75078836
  hyper
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcga

SEQ ID NO: 11969 - DNA, 208 bp, Homo sapiens
  chr14:76604597-76604805
  hyper
tcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtg

SEQ ID NO: 11970 - DNA, 307 bp, Homo sapiens
  chr14:76605040-76605347
  hyper
caagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggg

SEQ ID NO: 11971 - DNA, 92 bp, Homo sapiens
  chr14:76819300-76819392
  hyper
cacacggccccgaatcgccgcgctcctgcgggccgcgcgcagggtcgccgggtaggcacaggcacgtcccgtggccacggacctttgccctc

SEQ ID NO: 11972 - DNA, 262 bp, Homo sapiens
  chr14:76843732-76843994
  hyper
cgctccacctgctcgggtacctgcccgggtctccccttgggcgctgcgcaccccacggcgcccccggcgggtgtcccggaggcaggttgtgtgcgcgtgcaaagtggtccctcggaaggcttaataataataatacataaaactctaggttcttacggacagctttcctgcttaactttgtgctcgtcttcctcttttttttctgacgcaaactaaattctccaagtcagcgtttctccagttccaccgtgctttcatttgt

SEQ ID NO: 11973 - DNA, 102 bp, Homo sapiens
  chr14:77227622-77227724
  hyper
ctggcacgttgaaaacgtcctccgcagcttcgcaccggcttcgcggcgccctgacagctgggtgaggagggagcgaatgcccaccggcgtccttggggtaac

SEQ ID NO: 11974 - DNA, 60 bp, Homo sapiens
  chr14:77228674-77228734
  hyper
gcagatgtgagcgtgcgagagttgtgtaggggattttgttccctccgaaactgagaccca

SEQ ID NO: 11975 - DNA, 46 bp, Homo sapiens
  chr14:77591352-77591398
  hyper
gacccaggttggctgcggcccgcggtccccgcgcagccaacactgg

SEQ ID NO: 11976 - DNA, 43 bp, Homo sapiens
  chr14:77606813-77606856
  hyper
atcaattgaaacaatcgatacactcacactcgctctcgggcac

SEQ ID NO: 11977 - DNA, 63 bp, Homo sapiens
  chr14:77606921-77606984
  hyper
cgctggctgcccgggctatttctttgcgaagagcgttttcatttgaggcgaaattaaaatccc

SEQ ID NO: 11978 - DNA, 89 bp, Homo sapiens
  chr14:77607253-77607342
  hyper
tcggccagccggaggcgcgagaaaagttctgggaaggcggttgcacctaggatgggtggatgccacggggcctccgtccaggctgtccc

SEQ ID NO: 11979 - DNA, 177 bp, Homo sapiens
  chr14:77607930-77608107
  hyper
aggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggc

SEQ ID NO: 11980 - DNA, 75 bp, Homo sapiens
  chr14:77737071-77737146
  hyper
ggcgccccagcgccccggcagcggccagttttccctccttcggggccggtcctgccgcgtgacccctttcccgcc

SEQ ID NO: 11981 - DNA, 333 bp, Homo sapiens
  chr14:77737147-77737480
  hyper
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacac

SEQ ID NO: 11982 - DNA, 148 bp, Homo sapiens
  chr14:77964498-77964646
  hyper
gctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccg

SEQ ID NO: 11983 - DNA, 30 bp, Homo sapiens
  chr14:78624601-78624631
  hyper
ctgctgggagctctccgtggtgctggaagc

SEQ ID NO: 11984 - DNA, 32 bp, Homo sapiens
  chr14:85996505-85996537
  hyper
tgtcgccgtcacttgcgcgtttggcattatcc

SEQ ID NO: 11985 - DNA, 55 bp, Homo sapiens
  chr14:85997871-85997926
  hyper
agaggataactgggacgggctggacccatacttgatacccgggaaactcctagag

SEQ ID NO: 11986 - DNA, 15 bp, Homo sapiens
  chr14:85998629-85998644
  hyper
cgggctcgttctccc

SEQ ID NO: 11987 - DNA, 10 bp, Homo sapiens
  chr14:85999522-85999532
  hyper
gctccaggag

SEQ ID NO: 11988 - DNA, 74 bp, Homo sapiens
  chr14:85999596-85999670
  hyper
cgcgaattcattactgtaaacatatccgggggtgtcaggaggggtaggggtgggggccgcggcgcctacattag

SEQ ID NO: 11989 - DNA, 74 bp, Homo sapiens
  chr14:86000400-86000474
  hyper
gcccttcctggccctcgcgggtctggcagaaagtaagagggaggcgaagttcaagatcccggggatgagcaccg

SEQ ID NO: 11990 - DNA, 120 bp, Homo sapiens
  chr14:88789455-88789575
  hyper
gctgcttcccaaaagcggtgccggcaggttaggggctgcgcagcctgaaggctggggctacggagaagcccactgcagtgtcactccagcccccgaaggcgtgtgcgcacacactcccgc

SEQ ID NO: 11991 - DNA, 90 bp, Homo sapiens
  chr14:88790076-88790166
  hyper
aggcgctgcaggaggcggaggaagggccgctgcggctccgccgcagacctcggcctccgggtcacctcttctcaccgctctcaccctgag

SEQ ID NO: 11992 - DNA, 67 bp, Homo sapiens
  chr14:88790467-88790534
  hyper
ggcagctcccggaagcggcggccccgggatcctgggaccagcagggcagatgcgaagggacccagac

SEQ ID NO: 11993 - DNA, 80 bp, Homo sapiens
  chr14:88793005-88793085
  hyper
cactcggtggcaaagcgctgctaccgggcacgggtctctgcagctcaaaacctgcccggctggagcgcaccaatagttgc

SEQ ID NO: 11994 - DNA, 70 bp, Homo sapiens; identical to SEQ ID NO: 1193
  chr14:89817946-89818016
  hyper

SEQ ID NO: 11995 - DNA, 487 bp, Homo sapiens; identical to SEQ ID NO: 4176
  chr14:90084100-90084587
  hyper

SEQ ID NO: 11996 - DNA, 266 bp, Homo sapiens
  chr14:90526555-90526821
  hyper
agtgagtaacagagccgagaggactgctaacagcaccagggtttctgatgaaaatgcactcgccagagctgtgtttctttattcgaaatcacacggttttactcaacagggctcctagcccttctgtctctgctcctggtgcgtaagggcggtgtgtggggctctgcgcctgaaaccgctctctcggaaggtgggaagatgcccacgtatccattcctctccgcgtacagattcgctcccacacgcccgggcgggtgattccggag

SEQ ID NO: 11997 - DNA, 217 bp, Homo sapiens
  chr14:90527714-90527931
  hyper
ccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 11998 - DNA, 118 bp, Homo sapiens
  chr14:90528584-90528702
  hyper
cctgaacgaggacaacgcgcgctttctgctgctggccgcgctcatcgtgctctacctgctgggcggcgccgccgtcttctccgcgctggagctggcgcacgagcgccaggccaagcag

SEQ ID NO: 11999 - DNA, 53 bp, Homo sapiens
  chr14:90850275-90850328
  hyper
gagctgcagaggctgcggagtgaacgcggccaggagcccgcctgggagcgcgc

SEQ ID NO: 12000 - DNA, 53 bp, Homo sapiens
  chr14:91580352-91580405
  hyper
ctttaagaactggggcgggctagctgccgaggagaccacgctgctgcatgggc

SEQ ID NO: 12001 - DNA, 38 bp, Homo sapiens
  chr14:92040828-92040866
  hyper
actcgtgggagtgcccgctccagcgtggtttctccttc

SEQ ID NO: 12002 - DNA, 40 bp, Homo sapiens
  chr14:92789502-92789542
  hyper
cctctcagacgctggcgcccgcagccgagaagccagagag

SEQ ID NO: 12003 - DNA, 20 bp, Homo sapiens
  chr14:92789802-92789822
  hyper
agggctgtggccgggcgagc

SEQ ID NO: 12004 - DNA, 140 bp, Homo sapiens
  chr14:92789959-92790099
  hyper
gcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgc

SEQ ID NO: 12005 - DNA, 231 bp, Homo sapiens
  chr14:92790436-92790667
  hyper
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcc

SEQ ID NO: 12006 - DNA, 53 bp, Homo sapiens
  chr14:92979781-92979834
  hyper
cggcgccggcacaggcggagggcgtcttccttcccctgcggccccaagccaag

SEQ ID NO: 12007 - DNA, 232 bp, Homo sapiens
  chr14:92980429-92980661
  hyper
gttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctgg

SEQ ID NO: 12008 - DNA, 44 bp, Homo sapiens
  chr14:93389650-93389694
  hyper
cggtgcctaggtgcccggccccacaccgccagctgctcggcgcc

SEQ ID NO: 12009 - DNA, 64 bp, Homo sapiens
  chr14:93389712-93389776
  hyper
cgccgctgtcctggctcttctgctctgcgccgggcaaggtgagcgagcgcggggagctcgcggg

SEQ ID NO: 12010 - DNA, 242 bp, Homo sapiens
  chr14:93897200-93897442
  hyper
ctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctggga

SEQ ID NO: 12011 - DNA, 124 bp, Homo sapiens
  chr14:94254335-94254459
  hyper
agctccagaatactgcgtgcataccttggccccatggacacctccagaaacagccaagcacacttactgcgccccattaacccccatacaactcactctcactgtgagcacacttcaaacccgg

SEQ ID NO: 12012 - DNA, 139 bp, Homo sapiens
  chr14:94254498-94254637
  hyper
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacat

SEQ ID NO: 12013 - DNA, 7 bp, Homo sapiens
  chr14:94255277-94255284
  hyper
accctca

SEQ ID NO: 12014 - DNA, 42 bp, Homo sapiens
  chr14:94255304-94255346
  hyper
cggcgggaggcgccggcagggagctcccgctggggcagcaaa

SEQ ID NO: 12015 - DNA, 23 bp, Homo sapiens
  chr14:94255584-94255607
  hyper
cccccaagcctctcccgaggctg

SEQ ID NO: 12016 - DNA, 46 bp, Homo sapiens
  chr14:94255669-94255715
  hyper
cgccgcactccccgcaggctctcccgggcgccggggctgaaaggtg

SEQ ID NO: 12017 - DNA, 287 bp, Homo sapiens
  chr14:94405701-94405988
  hyper
ttgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcgg

SEQ ID NO: 12018 - DNA, 358 bp, Homo sapiens; identical to SEQ ID NO: 4177
  chr14:95235025-95235383
  hyper

SEQ ID NO: 12019 - DNA, 30 bp, Homo sapiens
  chr14:95235665-95235695
  hyper
agaattgggggtgcacgggaatcaggggtg

SEQ ID NO: 12020 - DNA, 88 bp, Homo sapiens
  chr14:95236102-95236190
  hyper
agtagttgttgtagccgaggcgggagccgctgaccgcggccgggaggcccgcgccgccgggggccacggggcgcgggtagaaggcgcc

SEQ ID NO: 12021 - DNA, 30 bp, Homo sapiens
  chr14:95237011-95237041
  hyper
cttttttccccctttcggaattggttttgt

SEQ ID NO: 12022 - DNA, 212 bp, Homo sapiens; identical to SEQ ID NO: 1194
  chr14:95239421-95239633
  hyper

SEQ ID NO: 12023 - DNA, 30 bp, Homo sapiens
  chr14:95240484-95240514
  hyper
gagtagagccagaggcgcaaatgcctcctg

SEQ ID NO: 12024 - DNA, 24 bp, Homo sapiens
  chr14:96342286-96342310
  hyper
aagccacattcgccacgctcccgc

SEQ ID NO: 12025 - DNA, 26 bp, Homo sapiens
  chr14:96342605-96342631
  hyper
cgcagcgcgcgtcagcgggggctccc

SEQ ID NO: 12026 - DNA, 132 bp, Homo sapiens; identical to SEQ ID NO: 4179
  chr14:96342892-96343024
  hyper

SEQ ID NO: 12027 - DNA, 22 bp, Homo sapiens
  chr14:96343413-96343435
  hyper
ctcctcgccttcctgcggctcc

SEQ ID NO: 12028 - DNA, 118 bp, Homo sapiens
  chr14:96343667-96343785
  hyper
gcctggaggctgaactgcccgggcagacctggtgctttcttctgccttctggagaaagatgtgggtttgacatgcaggcgggagacctgtctggtctagataacggcatgtgtatgca

SEQ ID NO: 12029 - DNA, 140 bp, Homo sapiens
  chr14:97058943-97059083
  hyper
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcg

SEQ ID NO: 12030 - DNA, 211 bp, Homo sapiens
  chr14:97499277-97499488
  hyper
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccc

SEQ ID NO: 12031 - DNA, 317 bp, Homo sapiens
  chr14:97684971-97685288
  hyper
agtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgc

SEQ ID NO: 12032 - DNA, 131 bp, Homo sapiens; identical to SEQ ID NO: 4180
  chr14:97685497-97685628
  hyper

SEQ ID NO: 12033 - DNA, 61 bp, Homo sapiens; identical to SEQ ID NO: 4181
  chr14:97685882-97685943
  hyper

SEQ ID NO: 12034 - DNA, 38 bp, Homo sapiens
  chr14:99736151-99736189
  hyper
agcatataacctgcccgcggtctcgatggcacccagag

SEQ ID NO: 12035 - DNA, 32 bp, Homo sapiens
  chr14:99740538-99740570
  hyper
ccctaggacacacagcgcgtcagggacaggtc

SEQ ID NO: 12036 - DNA, 84 bp, Homo sapiens
  chr14:100111793-100111877
  hyper
tgccaggtgagcgggcgcgcggccaccgggcggggcggggcgcgggaggccgagtcctggagcagagatcggaaccccgcgggg

SEQ ID NO: 12037 - DNA, 333 bp, Homo sapiens
  chr14:100125656-100125989
  hyper
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaa

SEQ ID NO: 12038 - DNA, 390 bp, Homo sapiens
  chr14:100437560-100437950
  hyper
ggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 12039 - DNA, 160 bp, Homo sapiens
  chr14:100438017-100438177
  hyper
cgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtc

SEQ ID NO: 12040 - DNA, 30 bp, Homo sapiens
  chr14:100438385-100438415
  hyper
gacaatgaggtgagtcggggccggcgcctc

SEQ ID NO: 12041 - DNA, 300 bp, Homo sapiens
  chr14:100438631-100438931
  hyper
tctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctc

SEQ ID NO: 12042 - DNA, 45 bp, Homo sapiens
  chr14:101033483-101033528
  hyper
cgcctcggctcaggctccggaaggaaaacacgggaggggtgttcc

SEQ ID NO: 12043 - DNA, 50 bp, Homo sapiens
  chr14:101034056-101034106
  hyper
cgcgaggctccccagcgcctcgcggcgcgcacacacgcaccacacacacg

SEQ ID NO: 12044 - DNA, 328 bp, Homo sapiens
  chr14:101035152-101035480
  hyper
ccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcct

SEQ ID NO: 12045 - DNA, 171 bp, Homo sapiens; identical to SEQ ID NO: 4182
  chr14:101543828-101543999
  hyper

SEQ ID NO: 12046 - DNA, 55 bp, Homo sapiens
  chr14:101923114-101923169
  hyper
ttcaagttttcatagcgctcgtcaaacagagacctcggaacgctctgcagacatt

SEQ ID NO: 12047 - DNA, 127 bp, Homo sapiens
  chr14:101923560-101923687
  hyper
aaaagaggttctcagcggagcgtgtgtgaggcggggggttacgggggaggggagacggggcgggtgtgaagtctgtgccgggaaaagaaaaatatgagtgttctcttttgtgtgcgcacaaacagcc

SEQ ID NO: 12048 - DNA, 27 bp, Homo sapiens
  chr14:101924030-101924057
  hyper
gacgccctggcccggtgtccccgacgc

SEQ ID NO: 12049 - DNA, 6 bp, Homo sapiens
  chr14:101924432-101924438
  hyper
aaaggc

SEQ ID NO: 12050 - DNA, 5 bp, Homo sapiens
  chr14:101924457-101924462
  hyper
cgttg

SEQ ID NO: 12051 - DNA, 214 bp, Homo sapiens
  chr14:101924858-101925072
  hyper
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgccccccgcggcctcggcgacagcc

SEQ ID NO: 12052 - DNA, 6 bp, Homo sapiens
  chr14:101925699-101925705
  hyper
acccgc

SEQ ID NO: 12053 - DNA, 276 bp, Homo sapiens
  chr14:101925706-101925982
  hyper
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggac

SEQ ID NO: 12054 - DNA, 194 bp, Homo sapiens
  chr14:102026214-102026408
  hyper
cgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccc

SEQ ID NO: 12055 - DNA, 274 bp, Homo sapiens
  chr14:102029904-102030178
  hyper
ctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggg

SEQ ID NO: 12056 - DNA, 48 bp, Homo sapiens
  chr14:102030756-102030804
  hyper
ggacacagtgaaagccgctgaggcgggagtgtacggatccaggtgagg

SEQ ID NO: 12057 - DNA, 284 bp, Homo sapiens
  chr14:102247792-102248076
  hyper
acccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcgga

SEQ ID NO: 12058 - DNA, 746 bp, Homo sapiens; identical to SEQ ID NO: 4184
  chr14:103021342-103022088
  hyper

SEQ ID NO: 12059 - DNA, 90 bp, Homo sapiens
  chr14:103389798-103389888
  hyper
aggcgtcctgcagggcgcgtttgagcgggctctgcaggtatcagtagaagtccgttggagagcgcccgggcagggcgcccacagtctggc

SEQ ID NO: 12060 - DNA, 101 bp, Homo sapiens
  chr14:103394683-103394784
  hyper
ccaggggactgggggcggggtgggcgcggagcaggcccggacccccgcgtggcgccgcctcagcccgtgtctcttgcagctcctgccgctggatggggaac

SEQ ID NO: 12061 - DNA, 178 bp, Homo sapiens
  chr14:103395035-103395213
  hyper
cgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgc

SEQ ID NO: 12062 - DNA, 92 bp, Homo sapiens
  chr14:103550468-103550560
  hyper
cagccccgcggtgggcgtgagtgcgagggaggccgggagagcgcgtgtgggcggggagcgcgagaaggagagcgagccgggagagcgcggag

SEQ ID NO: 12063 - DNA, 314 bp, Homo sapiens
  chr14:103655254-103655568
  hyper
gcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgc

SEQ ID NO: 12064 - DNA, 77 bp, Homo sapiens
  chr14:103655569-103655646
  hyper
ccgcggggctgcggggtcgaggggaggggactagtgtgcaggggccaccctctccccagccccgccccccgagtcca

SEQ ID NO: 12065 - DNA, 44 bp, Homo sapiens
  chr14:103687345-103687389
  hyper
gcgcagccgcgttggcgcgagttttaaatcggtgccttcccagc

SEQ ID NO: 12066 - DNA, 201 bp, Homo sapiens; identical to SEQ ID NO: 4185
  chr14:103739949-103740150
  hyper

SEQ ID NO: 12067 - DNA, 79 bp, Homo sapiens
  chr14:103740358-103740437
  hyper
agccctgggtccaaacgggcaggagaggtcgctggtgcctccgcggtccccgccgcgcgcagaactcggccgagtgcac

SEQ ID NO: 12068 - DNA, 51 bp, Homo sapiens
  chr14:103745699-103745750
  hyper
aggtcgtggacgcggcgggcgccgagcacctggtcacgctccaggacctgg

SEQ ID NO: 12069 - DNA, 102 bp, Homo sapiens
  chr14:103989352-103989454
  hyper
gcctgcccagtcccccgcccaagacctcgaggccgaaacctcaggtccttggatatctggatcccctcgcacgcccttgcctctgggcgggaaactgaggcg

SEQ ID NO: 12070 - DNA, 35 bp, Homo sapiens
  chr14:104602310-104602345
  hyper
gggccaggaccccaacgcgccgtgtcctcaggaca

SEQ ID NO: 12071 - DNA, 65 bp, Homo sapiens
  chr14:104602711-104602776
  hyper
cggcggcggcgggcgcgcggccagtgaacgcgcgggcggggcggcggtggcgggaggcactaggg

SEQ ID NO: 12072 - DNA, 36 bp, Homo sapiens
  chr14:104604637-104604673
  hyper
ggcgggaggcgcatgcgcgcgcgcaactagatcctc

SEQ ID NO: 12073 - DNA, 368 bp, Homo sapiens
  chr14:104604902-104605270
  hyper
agccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 12074 - DNA, 91 bp, Homo sapiens
  chr14:105070996-105071087
  hyper
gcgggaccaccaccacgaagctgaacaggaaggccaagaagtagcaggcgcactgagcgaaaaggaaattgttgagcgccatggccggccc

SEQ ID NO: 12075 - DNA, 47 bp, Homo sapiens
  chr14:105310190-105310237
  hyper
caaagctcccctggccgcctttcaaaaccgaccgcctcccaactctc

SEQ ID NO: 12076 - DNA, 77 bp, Homo sapiens
  chr14:105310576-105310653
  hyper
taagattctgcaactcgacttttataggggaaaccaggcacgcatttcaaaatcttctcatccgtccccacctcctt

SEQ ID NO: 12077 - DNA, 164 bp, Homo sapiens
  chr14:105714232-105714396
  hyper
ggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgacctt

SEQ ID NO: 12078 - DNA, 190 bp, Homo sapiens; identical to SEQ ID NO: 4186
  chr15:23158337-23158527
  hyper

SEQ ID NO: 12079 - DNA, 104 bp, Homo sapiens; identical to SEQ ID NO: 4187
  chr15:26107640-26107744
  hyper

SEQ ID NO: 12080 - DNA, 482 bp, Homo sapiens; identical to SEQ ID NO: 4188
  chr15:26107845-26108327
  hyper

SEQ ID NO: 12081 - DNA, 17 bp, Homo sapiens
  chr15:26327547-26327564
  hyper
ctgcgcctgcgcctgcg

SEQ ID NO: 12082 - DNA, 213 bp, Homo sapiens
  chr15:26327610-26327823
  hyper
cgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttg

SEQ ID NO: 12083 - DNA, 30 bp, Homo sapiens
  chr15:27016662-27016692
  hyper
tccagagtgtccctccgcagaaaactaaac

SEQ ID NO: 12084 - DNA, 30 bp, Homo sapiens
  chr15:27017778-27017808
  hyper
cgccgccgtgggtcgcgcttcccgcaacgg

SEQ ID NO: 12085 - DNA, 28 bp, Homo sapiens
  chr15:27018301-27018329
  hyper
cgcgcgggcgcggggcgggggaggaggc

SEQ ID NO: 12086 - DNA, 17 bp, Homo sapiens
  chr15:27113012-27113029
  hyper
cgcgctcccagcccagg

SEQ ID NO: 12087 - DNA, 285 bp, Homo sapiens
  chr15:27212887-27213172
  hyper
aacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgct

SEQ ID NO: 12088 - DNA, 139 bp, Homo sapiens
  chr15:28340433-28340572
  hyper
ccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaag

SEQ ID NO: 12089 - DNA, 261 bp, Homo sapiens; identical to SEQ ID NO: 1195
  chr15:28341719-28341980
  hyper

SEQ ID NO: 12090 - DNA, 39 bp, Homo sapiens; identical to SEQ ID NO: 1196
  chr15:28341981-28342020
  hyper

SEQ ID NO: 12091 - DNA, 15 bp, Homo sapiens
  chr15:28342521-28342536
  hyper
cggccccaaggagct

SEQ ID NO: 12092 - DNA, 30 bp, Homo sapiens
  chr15:28344134-28344164
  hyper
cgcctggcagagagccggagggggtgctca

SEQ ID NO: 12093 - DNA, 61 bp, Homo sapiens
  chr15:28351758-28351819
  hyper
gcagggtgggggcaccgggcgcacgcggggaatttccccacgaccacggccacgccaaatg

SEQ ID NO: 12094 - DNA, 77 bp, Homo sapiens; identical to SEQ ID NO: 4192
  chr15:28352021-28352098
  hyper

SEQ ID NO: 12095 - DNA, 22 bp, Homo sapiens
  chr15:28352099-28352121
  hyper
ggctctggccccacggtgagcc

SEQ ID NO: 12096 - DNA, 270 bp, Homo sapiens; identical to SEQ ID NO: 4194
  chr15:28352152-28352422
  hyper

SEQ ID NO: 12097 - DNA, 148 bp, Homo sapiens; identical to SEQ ID NO: 4195
  chr15:29077246-29077394
  hyper

SEQ ID NO: 12098 - DNA, 170 bp, Homo sapiens; identical to SEQ ID NO: 4196
  chr15:29077428-29077598
  hyper

SEQ ID NO: 12099 - DNA, 291 bp, Homo sapiens; identical to SEQ ID NO: 4197
  chr15:29130757-29131048
  hyper

SEQ ID NO: 12100 - DNA, 99 bp, Homo sapiens; identical to SEQ ID NO: 4198
  chr15:29131532-29131631
  hyper

SEQ ID NO: 12101 - DNA, 152 bp, Homo sapiens; identical to SEQ ID NO: 4199
  chr15:29131755-29131907
  hyper

SEQ ID NO: 12102 - DNA, 30 bp, Homo sapiens
  chr15:29407444-29407474
  hyper
cagcctgtgggtgggcgggtgggtggaggg

SEQ ID NO: 12103 - DNA, 97 bp, Homo sapiens
  chr15:29862098-29862195
  hyper
gtcgcccacaaaccacgccgttctgggcggacgcgggaaaccagaagtccccgaagccaagtcagcgagcgaccacaggggccgcccggccgatccc

SEQ ID NO: 12104 - DNA, 47 bp, Homo sapiens
  chr15:29863563-29863610
  hyper
gatgggcgcgcggggcgctgaggacggggagacgggctgggagcaga

SEQ ID NO: 12105 - DNA, 90 bp, Homo sapiens
  chr15:30260547-30260637
  hyper
aaggacagacagaggcgggaggccgacgcccgggtgcgggtgccaggcgtcccggccgctccccgtcgccctacgcgccgcgggcacagc

SEQ ID NO: 12106 - DNA, 95 bp, Homo sapiens
  chr15:30261046-30261141
  hyper
cagctctgggccatccgccgccaccacagctcccaccgctcccgcgcccgccgcacccgcagctgcggccgtgcgtggcccgggctcccgctccc

SEQ ID NO: 12107 - DNA, 6 bp, Homo sapiens
  chr15:31775468-31775474
  hyper
cctcgc

SEQ ID NO: 12108 - DNA, 155 bp, Homo sapiens; identical to SEQ ID NO: 4201
  chr15:31775483-31775638
  hyper

SEQ ID NO: 12109 - DNA, 105 bp, Homo sapiens; identical to SEQ ID NO: 4202
  chr15:31775678-31775783
  hyper

SEQ ID NO: 12110 - DNA, 305 bp, Homo sapiens
  chr15:33009821-33010126
  hyper
cgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgc

SEQ ID NO: 12111 - DNA, 32 bp, Homo sapiens
  chr15:33010471-33010503
  hyper
ctcgggtgcgttgttcgcgggggtgaattgtg

SEQ ID NO: 12112 - DNA, 316 bp, Homo sapiens; identical to SEQ ID NO: 4203
  chr15:33010850-33011166
  hyper

SEQ ID NO: 12113 - DNA, 181 bp, Homo sapiens; identical to SEQ ID NO: 4204
  chr15:33011167-33011348
  hyper

SEQ ID NO: 12114 - DNA, 85 bp, Homo sapiens
  chr15:33602801-33602886
  hyper
ttaggggacatcctccggtcgccgcggggcgcgcgcctccgctgagtgtgcggtgcggtacccagcggtgcgggggaggctccac

SEQ ID NO: 12115 - DNA, 491 bp, Homo sapiens; identical to SEQ ID NO: 4205
  chr15:33603118-33603609
  hyper

SEQ ID NO: 12116 - DNA, 114 bp, Homo sapiens; identical to SEQ ID NO: 4206
  chr15:33603647-33603761
  hyper

SEQ ID NO: 12117 - DNA, 711 bp, Homo sapiens
  chr15:34728884-34729595
  hyper
gccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagct

SEQ ID NO: 12118 - DNA, 334 bp, Homo sapiens; identical to SEQ ID NO: 1198
  chr15:34786610-34786944
  hyper

SEQ ID NO: 12119 - DNA, 103 bp, Homo sapiens; identical to SEQ ID NO: 1199
  chr15:34787232-34787335
  hyper

SEQ ID NO: 12120 - DNA, 34 bp, Homo sapiens
  chr15:34806507-34806541
  hyper
cgccggagccgccctgcaccgccctgtcgcggtc

SEQ ID NO: 12121 - DNA, 69 bp, Homo sapiens
  chr15:34806978-34807047
  hyper
ctacggcgggaggggcgcggaaggggagcctgtccggagccgctgtcacggccgcgactacccagcggg

SEQ ID NO: 12122 - DNA, 30 bp, Homo sapiens
  chr15:35047119-35047149
  hyper
gggcacctggcgctccggcgcggcagcctg

SEQ ID NO: 12123 - DNA, 13 bp, Homo sapiens
  chr15:35047293-35047306
  hyper
cgtcggagcccga

SEQ ID NO: 12124 - DNA, 291 bp, Homo sapiens; identical to SEQ ID NO: 1200
  chr15:37180507-37180798
  hyper

SEQ ID NO: 12125 - DNA, 60 bp, Homo sapiens
  chr15:37403027-37403087
  hyper
gggggtgagctggctcgggccgggacagaggtctctctgcgtacgccccgctccgcccgg

SEQ ID NO: 12126 - DNA, 454 bp, Homo sapiens; identical to SEQ ID NO: 4210
  chr15:40211790-40212244
  hyper

SEQ ID NO: 12127 - DNA, 129 bp, Homo sapiens
  chr15:40575589-40575718
  hyper
ccacatgcacccaaccgggccaatcccaaagtcgcagtcttctctccccgccctccgcccccaaccgagtcggtgccctcggctccttagaaactggcgggacctcggcctcgtcggggaagactgaaa

SEQ ID NO: 12128 - DNA, 137 bp, Homo sapiens
  chr15:41787125-41787262
  hyper
cgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcg

SEQ ID NO: 12129 - DNA, 79 bp, Homo sapiens
  chr15:41804733-41804812
  hyper
gggtaagggctaactcggtggcgactactgccaccttgaagggcactcaaggtggacctccccgcggaatagtccaaga

SEQ ID NO: 12130 - DNA, 544 bp, Homo sapiens; identical to SEQ ID NO: 4211
  chr15:41805028-41805572
  hyper

SEQ ID NO: 12131 - DNA, 35 bp, Homo sapiens
  chr15:41877632-41877667
  hyper
accagcgcctttgtccgcggcgcagaagggcccca

SEQ ID NO: 12132 - DNA, 138 bp, Homo sapiens
  chr15:41913733-41913871
  hyper
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagt

SEQ ID NO: 12133 - DNA, 204 bp, Homo sapiens
  chr15:41952542-41952746
  hyper
ccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggag

SEQ ID NO: 12134 - DNA, 76 bp, Homo sapiens; identical to SEQ ID NO: 1201
  chr15:45403605-45403681
  hyper

SEQ ID NO: 12135 - DNA, 202 bp, Homo sapiens; identical to SEQ ID NO: 1202
  chr15:45403798-45404000
  hyper

SEQ ID NO: 12136 - DNA, 128 bp, Homo sapiens
  chr15:45405031-45405159
  hyper
agggtctcttggccccgggagcgcataagattgcgctgtgtaggcagcggagctgctgggcgcgtgttccccgcagattccccgctcagggcctttcgcgccccggcccttcgcgagccacggcccca

SEQ ID NO: 12137 - DNA, 124 bp, Homo sapiens
  chr15:45406627-45406751
  hyper
agcagcccacctccacgcttccttaacggagaggtgcaggactcagacttcaccagcccactcggtcccagccttgtacgcaaagagacgccaaggacgcgctctcccgcgtccaggcagcccc

SEQ ID NO: 12138 - DNA, 192 bp, Homo sapiens
  chr15:45421473-45421665
  hyper
ttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgac

SEQ ID NO: 12139 - DNA, 51 bp, Homo sapiens
  chr15:45427669-45427720
  hyper
aggccaaccaggtgacgggctggctggacggcagcgccatctatggttcct

SEQ ID NO: 12140 - DNA, 71 bp, Homo sapiens; identical to SEQ ID NO: 1203
  chr15:45479446-45479517
  hyper

SEQ ID NO: 12141 - DNA, 3 bp, Homo sapiens
  chr15:45479774-45479777
  hyper
ggg

SEQ ID NO: 12142 - DNA, 63 bp, Homo sapiens
  chr15:48009607-48009670
  hyper
gagggagccaggctccggctcgcctgatggattgacttggagatggatcgaattacaccattt

SEQ ID NO: 12143 - DNA, 449 bp, Homo sapiens
  chr15:48010067-48010516
  hyper
tgtgtgtgttgccactggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgc

SEQ ID NO: 12144 - DNA, 62 bp, Homo sapiens
  chr15:48010760-48010822
  hyper
caccggccaccccaccgcccacccggctcccggtgtctcctcccggccgctctacccagcaa

SEQ ID NO: 12145 - DNA, 63 bp, Homo sapiens
  chr15:48470388-48470451
  hyper
cgccaccagtggccccgggcacctcggccttgttggcgtccgccatcccgccgccgctgcctc

SEQ ID NO: 12146 - DNA, 438 bp, Homo sapiens; identical to SEQ ID NO: 1205
  chr15:48936775-48937213
  hyper

SEQ ID NO: 12147 - DNA, 432 bp, Homo sapiens; identical to SEQ ID NO: 1206
  chr15:48937214-48937646
  hyper

SEQ ID NO: 12148 - DNA, 638 bp, Homo sapiens; identical to SEQ ID NO: 1207
  chr15:48937709-48938347
  hyper

SEQ ID NO: 12149 - DNA, 162 bp, Homo sapiens; identical to SEQ ID NO: 1208
  chr15:48938348-48938510
  hyper

SEQ ID NO: 12150 - DNA, 342 bp, Homo sapiens; identical to SEQ ID NO: 4220
  chr15:51385864-51386206
  hyper

SEQ ID NO: 12151 - DNA, 414 bp, Homo sapiens
  chr15:51559380-51559794
  hyper
gcaaaaccagctcctcgtattgtgtcccattcacagctggagcagctcgggcactaggcgaggcagggggtgcggcgagcggtctccagccggctgcctgcggtcggtgccgcccgcagaatctgcgcggcccagtgcaaaataaaaacgcggggccccgcgttcaaaaagcaggaaaaagcctttccctttctcccgtggtctttctgtccacctgtctcggcagggtttatttgctagttaagttgcgctggcttgagcacagggacgctggcgggccaaaggccgaccctcacaggcgacccagcgtggcggcgaggtcccttggctgtacgccgaggtctgcgccgcccccacgtccgtggccggccactgcccagggcggagggcagcggtgttcgccgggtgggggcc

SEQ ID NO: 12152 - DNA, 15 bp, Homo sapiens
  chr15:53075850-53075865
  hyper
acaaaacaaaggaac

SEQ ID NO: 12153 - DNA, 1016 bp, Homo sapiens; identical to SEQ ID NO: 1210
  chr15:53075985-53077001
  hyper

SEQ ID NO: 12154 - DNA, 461 bp, Homo sapiens; identical to SEQ ID NO: 1211
  chr15:53077065-53077526
  hyper

SEQ ID NO: 12155 - DNA, 158 bp, Homo sapiens
  chr15:53078040-53078198
  hyper
ctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagcc

SEQ ID NO: 12156 - DNA, 70 bp, Homo sapiens
  chr15:53078922-53078992
  hyper
ccatggctcagaggtcgtctctgaacagaacgtgtcagtctgtccttccagggggcgacagcaggcagtg

SEQ ID NO: 12157 - DNA, 414 bp, Homo sapiens; identical to SEQ ID NO: 4224
  chr15:53079264-53079678
  hyper

SEQ ID NO: 12158 - DNA, 175 bp, Homo sapiens; identical to SEQ ID NO: 4225
  chr15:53079717-53079892
  hyper

SEQ ID NO: 12159 - DNA, 84 bp, Homo sapiens; identical to SEQ ID NO: 4226
  chr15:53079970-53080054
  hyper

SEQ ID NO: 12160 - DNA, 205 bp, Homo sapiens; identical to SEQ ID NO: 4227
  chr15:53080337-53080542
  hyper

SEQ ID NO: 12161 - DNA, 56 bp, Homo sapiens; identical to SEQ ID NO: 4228
  chr15:53080935-53080991
  hyper

SEQ ID NO: 12162 - DNA, 243 bp, Homo sapiens; identical to SEQ ID NO: 4229
  chr15:53081054-53081297
  hyper

SEQ ID NO: 12163 - DNA, 293 bp, Homo sapiens; identical to SEQ ID NO: 4230
  chr15:53081398-53081691
  hyper

SEQ ID NO: 12164 - DNA, 56 bp, Homo sapiens
  chr15:53082987-53083043
  hyper
ctaagctttatttcccggggggctgctgggagtgcgctttcccacccttgaattca

SEQ ID NO: 12165 - DNA, 19 bp, Homo sapiens
  chr15:53083116-53083135
  hyper
cgttgacccggcacccttc

SEQ ID NO: 12166 - DNA, 3 bp, Homo sapiens
  chr15:53083136-53083139
  hyper
tcc

SEQ ID NO: 12167 - DNA, 401 bp, Homo sapiens
  chr15:53095746-53096147
  hyper
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctct

SEQ ID NO: 12168 - DNA, 36 bp, Homo sapiens
  chr15:53096459-53096495
  hyper
acatgagatcaggttcgcgttcgaggatttgccccc

SEQ ID NO: 12169 - DNA, 238 bp, Homo sapiens
  chr15:53097098-53097336
  hyper
tggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggagg

SEQ ID NO: 12170 - DNA, 15 bp, Homo sapiens
  chr15:53097554-53097569
  hyper
tttttttcgctttgc

SEQ ID NO: 12171 - DNA, 59 bp, Homo sapiens; identical to SEQ ID NO: 4232
  chr15:53097777-53097836
  hyper

SEQ ID NO: 12172 - DNA, 274 bp, Homo sapiens; identical to SEQ ID NO: 4233
  chr15:53098416-53098690
  hyper

SEQ ID NO: 12173 - DNA, 45 bp, Homo sapiens
  chr15:54051776-54051821
  hyper
caccagcctgggacccggcagcccgacctgcgctctgggggtgcc

SEQ ID NO: 12174 - DNA, 296 bp, Homo sapiens
  chr15:54270601-54270897
  hyper
gaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 12175 - DNA, 45 bp, Homo sapiens
  chr15:56034885-56034930
  hyper
cgcagggcgagagcgggggccgggggtcagcgccaccacggagga

SEQ ID NO: 12176 - DNA, 21 bp, Homo sapiens
  chr15:58357799-58357820
  hyper
cggggtcggccttcacctcgc

SEQ ID NO: 12177 - DNA, 155 bp, Homo sapiens
  chr15:58358573-58358728
  hyper
aggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggagg

SEQ ID NO: 12178 - DNA, 548 bp, Homo sapiens; identical to SEQ ID NO: 1212
  chr15:60287038-60287586
  hyper

SEQ ID NO: 12179 - DNA, 33 bp, Homo sapiens; identical to SEQ ID NO: 1213
  chr15:60287643-60287676
  hyper

SEQ ID NO: 12180 - DNA, 30 bp, Homo sapiens
  chr15:60288814-60288844
  hyper
cgatcctctgaagatcgggttaatgattta

SEQ ID NO: 12181 - DNA, 189 bp, Homo sapiens; identical to SEQ ID NO: 4236
  chr15:60289310-60289499
  hyper

SEQ ID NO: 12182 - DNA, 266 bp, Homo sapiens; identical to SEQ ID NO: 1214
  chr15:60295917-60296183
  hyper

SEQ ID NO: 12183 - DNA, 18 bp, Homo sapiens
  chr15:60296600-60296618
  hyper
cgctgccaccatccgcgc

SEQ ID NO: 12184 - DNA, 256 bp, Homo sapiens; identical to SEQ ID NO: 1216
  chr15:60297153-60297409
  hyper

SEQ ID NO: 12185 - DNA, 153 bp, Homo sapiens; identical to SEQ ID NO: 4240
  chr15:60297674-60297827
  hyper

SEQ ID NO: 12186 - DNA, 228 bp, Homo sapiens; identical to SEQ ID NO: 4241
  chr15:60297941-60298169
  hyper

SEQ ID NO: 12187 - DNA, 82 bp, Homo sapiens
  chr15:61519939-61520021
  hyper
ggccggtacccaagccggggctggagaaatcctctccgtccccagctccaggcggctcgcgcgagcacgcttcctccggagt

SEQ ID NO: 12188 - DNA, 30 bp, Homo sapiens
  chr15:61520432-61520462
  hyper
cggatgcgcgtggagcgccccacaggaccg

SEQ ID NO: 12189 - DNA, 30 bp, Homo sapiens
  chr15:61520933-61520963
  hyper
atttaattgaggcaacgcagctttcctcca

SEQ ID NO: 12190 - DNA, 30 bp, Homo sapiens
  chr15:61521442-61521472
  hyper
ggagatggcgagctccgagactccctctat

SEQ ID NO: 12191 - DNA, 32 bp, Homo sapiens
  chr15:61521809-61521841
  hyper
gagaacagagcctcccgcgccccaatcctccc

SEQ ID NO: 12192 - DNA, 75 bp, Homo sapiens
  chr15:62457193-62457268
  hyper
tggggctaggagtggcgggaagaggtgcgcctgcgggggagagaagctgctgagtttgggcgcctggagctgctg

SEQ ID NO: 12193 - DNA, 91 bp, Homo sapiens
  chr15:65669680-65669771
  hyper
cagcgcttagccttgcggtctcccctggctcgtttccctcggtctccacgccagcccgccccgcttgctcccgcttcgctgcactccttgc

SEQ ID NO: 12194 - DNA, 35 bp, Homo sapiens
  chr15:65715528-65715563
  hyper
gtgcctcgccctctccgggtcgccgcgggcccccg

SEQ ID NO: 12195 - DNA, 126 bp, Homo sapiens
  chr15:68113248-68113374
  hyper
gcaatcggtaaagtgcggtccgcggtgatattaacccgccggacgccggcccatagtagagccccagctcctacccccacgacctgctccccggtgcccagccctgagcagcggggcttccccagc

SEQ ID NO: 12196 - DNA, 260 bp, Homo sapiens
  chr15:68114139-68114399
  hyper
cggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgaggga

SEQ ID NO: 12197 - DNA, 939 bp, Homo sapiens; identical to SEQ ID NO: 4242
  chr15:68115594-68116533
  hyper

SEQ ID NO: 12198 - DNA, 326 bp, Homo sapiens; identical to SEQ ID NO: 4243
  chr15:68117665-68117991
  hyper

SEQ ID NO: 12199 - DNA, 404 bp, Homo sapiens
  chr15:68118253-68118657
  hyper
ctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaa

SEQ ID NO: 12200 - DNA, 809 bp, Homo sapiens; identical to SEQ ID NO: 1217
  chr15:68121149-68121958
  hyper

SEQ ID NO: 12201 - DNA, 40 bp, Homo sapiens
  chr15:68122643-68122683
  hyper
agcccttgaacccatcgctctccaccgcacccaggagctg

SEQ ID NO: 12202 - DNA, 488 bp, Homo sapiens; identical to SEQ ID NO: 1218
  chr15:68125223-68125711
  hyper

SEQ ID NO: 12203 - DNA, 33 bp, Homo sapiens
  chr15:68126071-68126104
  hyper
ctccccagaagcccacgacgccctgcaccattt

SEQ ID NO: 12204 - DNA, 647 bp, Homo sapiens; identical to SEQ ID NO: 4246
  chr15:68127766-68128413
  hyper

SEQ ID NO: 12205 - DNA, 44 bp, Homo sapiens
  chr15:68723523-68723567
  hyper
tcagggctggcttcccgctcccagccgcgcgcccctcgggccgg

SEQ ID NO: 12206 - DNA, 124 bp, Homo sapiens
  chr15:68723898-68724022
  hyper
tttgagatgcttccccggagccaggcaggagggcagccagggcacactctcttggcgctgattcccttccccagccggggccgtgcgccctcggcgctcccgggacacccgagtgcccctggca

SEQ ID NO: 12207 - DNA, 121 bp, Homo sapiens
  chr15:69136224-69136345
  hyper
acatacacacacacacgtgtgtgtgtttcggggctgctcaggaggacaggcggctctgcgctgcggctgtggtgggctccgtgcacaccgcgctaggctcatagggcggctggcaggtcca

SEQ ID NO: 12208 - DNA, 34 bp, Homo sapiens
  chr15:71408553-71408587
  hyper
gttgctgcaacccagcgagcgcctggagcccgag

SEQ ID NO: 12209 - DNA, 132 bp, Homo sapiens
  chr15:72476743-72476875
  hyper
cacagccagagcttgcgcaggccggggagctgccaggagtgccgcagccgtgcccccacctgctgggctcccgggaaaaggagcgcgcgcccctctgagccccttcctggtgcagtgcgtgtaccaagcgtg

SEQ ID NO: 12210 - DNA, 727 bp, Homo sapiens
  chr15:73659600-73660327
  hyper
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaag

SEQ ID NO: 12211 - DNA, 267 bp, Homo sapiens
  chr15:73660446-73660713
  hyper
cgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcc

SEQ ID NO: 12212 - DNA, 109 bp, Homo sapiens
  chr15:73661626-73661735
  hyper
tttcctcttgggaggcgaccgggttcgtctggatgcagagtcccggccttcccgcaaccctcctggagagggggcttccggaaatgcgccgcgtcggggaggctcccac

SEQ ID NO: 12213 - DNA, 109 bp, Homo sapiens
  chr15:74422006-74422115
  hyper
atcagagctagggagcgacagtcgggaacagcgagtctgccgaagccggctgttgtgtgagggtgtgagacggcggggcggtgaggggccaccgcggcttgggggatag

SEQ ID NO: 12214 - DNA, 30 bp, Homo sapiens
  chr15:74428205-74428235
  hyper
tccaaagcctcctgccggcagggaaccaaa

SEQ ID NO: 12215 - DNA, 59 bp, Homo sapiens
  chr15:74429026-74429085
  hyper
gatcagccctctccgcgaagcgcagcacaagcgcgggcctgggacggagtagccccccg

SEQ ID NO: 12216 - DNA, 254 bp, Homo sapiens; identical to SEQ ID NO: 4247
  chr15:74658143-74658397
  hyper

SEQ ID NO: 12217 - DNA, 52 bp, Homo sapiens; identical to SEQ ID NO: 4248
  chr15:74658501-74658553
  hyper

SEQ ID NO: 12218 - DNA, 91 bp, Homo sapiens; identical to SEQ ID NO: 4249
  chr15:74658554-74658645
  hyper

SEQ ID NO: 12219 - DNA, 114 bp, Homo sapiens
  chr15:75251672-75251786
  hyper
tacatcgtgattagccgcggggtcgctaattacagctgaagccattcattacactgtcagcgcgcgtcgcagcccgccggctgtgcgctccctcctagccgtgaaggggtgtag

SEQ ID NO: 12220 - DNA, 10 bp, Homo sapiens
  chr15:75471217-75471227
  hyper
cggtttcccc

SEQ ID NO: 12221 - DNA, 29 bp, Homo sapiens
  chr15:76627508-76627537
  hyper
tcctaaaggtggaggcggagctcaaaagc

SEQ ID NO: 12222 - DNA, 251 bp, Homo sapiens; identical to SEQ ID NO: 1220
  chr15:76627575-76627826
  hyper

SEQ ID NO: 12223 - DNA, 462 bp, Homo sapiens; identical to SEQ ID NO: 4252
  chr15:76628564-76629026
  hyper

SEQ ID NO: 12224 - DNA, 58 bp, Homo sapiens; identical to SEQ ID NO: 4253
  chr15:76629162-76629220
  hyper

SEQ ID NO: 12225 - DNA, 281 bp, Homo sapiens; identical to SEQ ID NO: 1221
  chr15:76629814-76630095
  hyper

SEQ ID NO: 12226 - DNA, 29 bp, Homo sapiens
  chr15:76630096-76630125
  hyper
gccccgcgcccttccccggcagagaagcc

SEQ ID NO: 12227 - DNA, 244 bp, Homo sapiens; identical to SEQ ID NO: 1223
  chr15:76630519-76630763
  hyper

SEQ ID NO: 12228 - DNA, 38 bp, Homo sapiens
  chr15:76638937-76638975
  hyper
cgagctacaaccagacgcggccgcgctcacctgggcgt

SEQ ID NO: 12229 - DNA, 83 bp, Homo sapiens
  chr15:77924565-77924648
  hyper
gggcgcagccagggccgatggcggcccccaggggcactcgccgcggggctgcccgctcggggctcggccgcggccgcctggct

SEQ ID NO: 12230 - DNA, 148 bp, Homo sapiens
  chr15:78111627-78111775
  hyper
gtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgt

SEQ ID NO: 12231 - DNA, 111 bp, Homo sapiens
  chr15:78236783-78236894
  hyper
cgcacacactgtttgcggagaggccagggcagacaacctccacccgtttccggagccactggcgccccctcattcccgctccagcagcccatgcctcgcttcacccctggt

SEQ ID NO: 12232 - DNA, 59 bp, Homo sapiens
  chr15:78633047-78633106
  hyper
ttgctgaatgtttggcgccctcctcgatggtgcggactttatctcgtgctagatcatag

SEQ ID NO: 12233 - DNA, 91 bp, Homo sapiens; identical to SEQ ID NO: 4257
  chr15:78912281-78912372
  hyper

SEQ ID NO: 12234 - DNA, 212 bp, Homo sapiens; identical to SEQ ID NO: 4258
  chr15:78912441-78912653
  hyper

SEQ ID NO: 12235 - DNA, 30 bp, Homo sapiens
  chr15:78912912-78912942
  hyper
agtctgcgcgggttccgagtccccggcgac

SEQ ID NO: 12236 - DNA, 174 bp, Homo sapiens
  chr15:78913296-78913470
  hyper
cagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 12237 - DNA, 197 bp, Homo sapiens
  chr15:78913480-78913677
  hyper
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatatt

SEQ ID NO: 12238 - DNA, 230 bp, Homo sapiens
  chr15:78933407-78933637
  hyper
gaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccact

SEQ ID NO: 12239 - DNA, 900 bp, Homo sapiens; identical to SEQ ID NO: 1224
  chr15:79382098-79382998
  hyper

SEQ ID NO: 12240 - DNA, 258 bp, Homo sapiens; identical to SEQ ID NO: 1225
  chr15:79382999-79383257
  hyper

SEQ ID NO: 12241 - DNA, 67 bp, Homo sapiens; identical to SEQ ID NO: 1226
  chr15:79383317-79383384
  hyper

SEQ ID NO: 12242 - DNA, 81 bp, Homo sapiens; identical to SEQ ID NO: 1227
  chr15:79383438-79383519
  hyper

SEQ ID NO: 12243 - DNA, 199 bp, Homo sapiens
  chr15:79383947-79384146
  hyper
gcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 12244 - DNA, 82 bp, Homo sapiens
  chr15:79502170-79502252
  hyper
actgtaagtgttggacggagaactgataagggtaggtgattgacactcacagcctccggaacccccgcgccgcctgcacttg

SEQ ID NO: 12245 - DNA, 94 bp, Homo sapiens
  chr15:79574968-79575062
  hyper
gggtggggcagcaggcgcctctgccgaggctgcaggtaggcacttccccacccccgcggccccctccttcctccttcctcgcagctcgcacacc

SEQ ID NO: 12246 - DNA, 206 bp, Homo sapiens
  chr15:79575293-79575499
  hyper
cgcaacttggaggagcggtggaccgatttgaaggaactgacgcagaggttttattcacgaaccttgaagaagttctgggcaagtgactcaacaggacccgcggggcccggggtagccccagctcccggcgctggttcagtctggcagtgccctctggcagccaacccgcagctgcaggtaggggtgctggacgccccctgattttg

SEQ ID NO: 12247 - DNA, 223 bp, Homo sapiens
  chr15:79576060-79576283
  hyper
gctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgc

SEQ ID NO: 12248 - DNA, 210 bp, Homo sapiens; identical to SEQ ID NO: 4263
  chr15:79724351-79724561
  hyper

SEQ ID NO: 12249 - DNA, 187 bp, Homo sapiens; identical to SEQ ID NO: 4264
  chr15:79724606-79724793
  hyper

SEQ ID NO: 12250 - DNA, 163 bp, Homo sapiens; identical to SEQ ID NO: 4265
  chr15:79724863-79725026
  hyper

SEQ ID NO: 12251 - DNA, 75 bp, Homo sapiens; identical to SEQ ID NO: 4266
  chr15:79725422-79725497
  hyper

SEQ ID NO: 12252 - DNA, 162 bp, Homo sapiens
  chr15:80544504-80544666
  hyper
gagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 12253 - DNA, 290 bp, Homo sapiens
  chr15:82336879-82337169
  hyper
agacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccat

SEQ ID NO: 12254 - DNA, 180 bp, Homo sapiens; identical to SEQ ID NO: 4267
  chr15:82340007-82340187
  hyper

SEQ ID NO: 12255 - DNA, 35 bp, Homo sapiens
  chr15:83314969-83315004
  hyper
ccgctagcaagggaccgcaccgtcacctgaggggc

SEQ ID NO: 12256 - DNA, 84 bp, Homo sapiens
  chr15:83315297-83315381
  hyper
ccccagctgagagcacggtgcaaggggccagggctgcagggagcaaagtgcccccgaaaaataagcgcgcgcccacgaaagcgc

SEQ ID NO: 12257 - DNA, 409 bp, Homo sapiens; identical to SEQ ID NO: 4268
  chr15:83316231-83316640
  hyper

SEQ ID NO: 12258 - DNA, 333 bp, Homo sapiens; identical to SEQ ID NO: 4269
  chr15:83316641-83316974
  hyper

SEQ ID NO: 12259 - DNA, 542 bp, Homo sapiens; identical to SEQ ID NO: 4270
  chr15:83349070-83349612
  hyper

SEQ ID NO: 12260 - DNA, 38 bp, Homo sapiens; identical to SEQ ID NO: 4271
  chr15:83349671-83349709
  hyper

SEQ ID NO: 12261 - DNA, 165 bp, Homo sapiens
  chr15:83378857-83379022
  hyper
agctgcccccacccccgaccacctggcctcggcgggacgggcctctggggctccgctctccccagacgcacgcgcggatgctcacccacgccgtggagggaaagcgggaactggaaagaaggctgtgcccgcaggctgggggttctagagcgggaaggggtcacc

SEQ ID NO: 12262 - DNA, 69 bp, Homo sapiens; identical to SEQ ID NO: 4272
  chr15:83775933-83776002
  hyper

SEQ ID NO: 12263 - DNA, 116 bp, Homo sapiens; identical to SEQ ID NO: 4273
  chr15:83776022-83776138
  hyper

SEQ ID NO: 12264 - DNA, 112 bp, Homo sapiens; identical to SEQ ID NO: 4274
  chr15:83776157-83776269
  hyper

SEQ ID NO: 12265 - DNA, 37 bp, Homo sapiens; identical to SEQ ID NO: 4275
  chr15:83776270-83776307
  hyper

SEQ ID NO: 12266 - DNA, 385 bp, Homo sapiens; identical to SEQ ID NO: 4276
  chr15:83776332-83776717
  hyper

SEQ ID NO: 12267 - DNA, 176 bp, Homo sapiens
  chr15:83875705-83875881
  hyper
cgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgc

SEQ ID NO: 12268 - DNA, 260 bp, Homo sapiens
  chr15:83876223-83876483
  hyper
ccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgt

SEQ ID NO: 12269 - DNA, 34 bp, Homo sapiens
  chr15:83876788-83876822
  hyper
gaagcccgcgccgggcgggcgggagtgcctactc

SEQ ID NO: 12270 - DNA, 113 bp, Homo sapiens
  chr15:83877036-83877149
  hyper
agtgggggacaaaggcgctccaggcctgggggacggcggcgcgaggggaccctctgctgggcaccaagctgccggaaagagcaccgctccggagtcagcgaccttattggatt

SEQ ID NO: 12271 - DNA, 64 bp, Homo sapiens; identical to SEQ ID NO: 1228
  chr15:84115747-84115811
  hyper

SEQ ID NO: 12272 - DNA, 42 bp, Homo sapiens; identical to SEQ ID NO: 1229
  chr15:84115812-84115854
  hyper

SEQ ID NO: 12273 - DNA, 194 bp, Homo sapiens; identical to SEQ ID NO: 1230
  chr15:84115931-84116125
  hyper

SEQ ID NO: 12274 - DNA, 41 bp, Homo sapiens
  chr15:84116828-84116869
  hyper
cgaaatggccccgtctggactgtgcccggctccccggctgg

SEQ ID NO: 12275 - DNA, 33 bp, Homo sapiens
  chr15:84322478-84322511
  hyper
cggcggcggtggcggcgtcggcaatcccggctc

SEQ ID NO: 12276 - DNA, 44 bp, Homo sapiens
  chr15:84322993-84323037
  hyper
ggggctgcacgtcccagatacttctgcggcgcaaggtgggtgca

SEQ ID NO: 12277 - DNA, 42 bp, Homo sapiens; identical to SEQ ID NO: 1231
  chr15:84748578-84748620
  hyper

SEQ ID NO: 12278 - DNA, 691 bp, Homo sapiens; identical to SEQ ID NO: 1232
  chr15:84748678-84749369
  hyper

SEQ ID NO: 12279 - DNA, 41 bp, Homo sapiens
  chr15:88799221-88799262
  hyper
ggaagaggttcccatcgtccggccgccggcaattgatctca

SEQ ID NO: 12280 - DNA, 492 bp, Homo sapiens; identical to SEQ ID NO: 1233
  chr15:88799507-88799999
  hyper

SEQ ID NO: 12281 - DNA, 302 bp, Homo sapiens; identical to SEQ ID NO: 1234
  chr15:88800000-88800302
  hyper

SEQ ID NO: 12282 - DNA, 555 bp, Homo sapiens; identical to SEQ ID NO: 1235
  chr15:88800412-88800967
  hyper

SEQ ID NO: 12283 - DNA, 30 bp, Homo sapiens
  chr15:88801202-88801232
  hyper
tgaaaaaaaaaaaaacgagcattcgctgtg

SEQ ID NO: 12284 - DNA, 30 bp, Homo sapiens
  chr15:89147617-89147647
  hyper
gtgtctcttctggtccgggcacaactggat

SEQ ID NO: 12285 - DNA, 35 bp, Homo sapiens
  chr15:89148146-89148181
  hyper
gtcttcctccctagccgcggcgacccatgccaggt

SEQ ID NO: 12286 - DNA, 231 bp, Homo sapiens
  chr15:89148437-89148668
  hyper
gttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctc

SEQ ID NO: 12287 - DNA, 40 bp, Homo sapiens
  chr15:89148879-89148919
  hyper
tctgctgaaagagagcgcctaatgccgttacttcccagtg

SEQ ID NO: 12288 - DNA, 213 bp, Homo sapiens; identical to SEQ ID NO: 4285
  chr15:89149139-89149352
  hyper

SEQ ID NO: 12289 - DNA, 53 bp, Homo sapiens
  chr15:89248428-89248481
  hyper
ggaggctgacgggggcgcagcttttcctcctgagtgttcgctgcccgggctgg

SEQ ID NO: 12290 - DNA, 92 bp, Homo sapiens
  chr15:89248695-89248787
  hyper
ggggagggactggatcgggcgccaatcccgcccgccgcgcgccgcccgggctccctcgggctctcatttaccccggccgctggcagcgggac

SEQ ID NO: 12291 - DNA, 289 bp, Homo sapiens; identical to SEQ ID NO: 1236
  chr15:89346038-89346327
  hyper

SEQ ID NO: 12292 - DNA, 115 bp, Homo sapiens; identical to SEQ ID NO: 1237
  chr15:89346346-89346461
  hyper

SEQ ID NO: 12293 - DNA, 321 bp, Homo sapiens
  chr15:89346895-89347216
  hyper
gcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagca

SEQ ID NO: 12294 - DNA, 383 bp, Homo sapiens; identical to SEQ ID NO: 1238
  chr15:89903431-89903814
  hyper

SEQ ID NO: 12295 - DNA, 86 bp, Homo sapiens
  chr15:89906156-89906242
  hyper
ggtgcgctcccactgcgggtgggaggcaggactcagtcatcccgggcaaagggttgtggggcagtgggaagcgcccagaggtgagg

SEQ ID NO: 12296 - DNA, 30 bp, Homo sapiens
  chr15:89909322-89909352
  hyper
aaaggaatgtgtctgcgaagtgggatttcg

SEQ ID NO: 12297 - DNA, 493 bp, Homo sapiens
  chr15:89910545-89911038
  hyper
ccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcag

SEQ ID NO: 12298 - DNA, 486 bp, Homo sapiens
  chr15:89911610-89912096
  hyper
gggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 12299 - DNA, 95 bp, Homo sapiens
  chr15:89913460-89913555
  hyper
gccttcctccctcaccggccaacgggtgtgggcaaaccctgggccccgggcttcgatcttcccctcccaccacccctacccgtttgctgtgttgc

SEQ ID NO: 12300 - DNA, 118 bp, Homo sapiens
  chr15:89914332-89914450
  hyper
ccactgacagggcagcgatcagtacagccaccgtggtgggcgaggcatccggggcttccttttctctggtccacgaactcccaactccgaacgctgtgggactgcatgggcctctgcc

SEQ ID NO: 12301 - DNA, 503 bp, Homo sapiens
  chr15:89914866-89915369
  hyper
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccacccca

SEQ ID NO: 12302 - DNA, 248 bp, Homo sapiens; identical to SEQ ID NO: 1239
  chr15:89922499-89922747
  hyper

SEQ ID NO: 12303 - DNA, 590 bp, Homo sapiens
  chr15:89942665-89943255
  hyper
ggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaa

SEQ ID NO: 12304 - DNA, 326 bp, Homo sapiens; identical to SEQ ID NO: 1240
  chr15:89949616-89949942
  hyper

SEQ ID NO: 12305 - DNA, 126 bp, Homo sapiens; identical to SEQ ID NO: 1241
  chr15:89950355-89950481
  hyper

SEQ ID NO: 12306 - DNA, 15 bp, Homo sapiens
  chr15:89950722-89950737
  hyper
agttagttacttagc

SEQ ID NO: 12307 - DNA, 208 bp, Homo sapiens; identical to SEQ ID NO: 4293
  chr15:89951081-89951289
  hyper

SEQ ID NO: 12308 - DNA, 28 bp, Homo sapiens
  chr15:89951349-89951377
  hyper
gataaactcgcttttcttccggtaagtg

SEQ ID NO: 12309 - DNA, 90 bp, Homo sapiens; identical to SEQ ID NO: 4295
  chr15:89951465-89951555
  hyper

SEQ ID NO: 12310 - DNA, 308 bp, Homo sapiens; identical to SEQ ID NO: 1242
  chr15:89952145-89952453
  hyper

SEQ ID NO: 12311 - DNA, 375 bp, Homo sapiens; identical to SEQ ID NO: 1243
  chr15:89952699-89953074
  hyper

SEQ ID NO: 12312 - DNA, 30 bp, Homo sapiens
  chr15:89954324-89954354
  hyper
ttagctcagccctggcgctgccttccagga

SEQ ID NO: 12313 - DNA, 42 bp, Homo sapiens
  chr15:89954800-89954842
  hyper
cattgtgcagactcccggggtcaggtcgcagggtcacgtgca

SEQ ID NO: 12314 - DNA, 28 bp, Homo sapiens
  chr15:89955001-89955029
  hyper
gggatagtcgcaccgacaaaaatcacag

SEQ ID NO: 12315 - DNA, 15 bp, Homo sapiens
  chr15:89956339-89956354
  hyper
tatattttaagcccc

SEQ ID NO: 12316 - DNA, 30 bp, Homo sapiens
  chr15:89962817-89962847
  hyper
ctccgttggggtcaccgacagaggctcact

SEQ ID NO: 12317 - DNA, 224 bp, Homo sapiens
  chr15:90039584-90039808
  hyper
gacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcggg

SEQ ID NO: 12318 - DNA, 177 bp, Homo sapiens
  chr15:90357883-90358060
  hyper
gcagaagtccagctccgcacgcgccaagcgctgggtctgcagctccctcggttcccgcgcacccaactgccccacgacccctacccgcgcccgcagcccccgccctcccgccccacttgcctgggccgccgggcgctggaacctggaccctggaccctggcgggttccgagctgcgc

SEQ ID NO: 12319 - DNA, 248 bp, Homo sapiens
  chr15:90358102-90358350
  hyper
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctg

SEQ ID NO: 12320 - DNA, 120 bp, Homo sapiens
  chr15:91427788-91427908
  hyper
ggggcctggaggagcggtgggagctgggggcgcggcaggcaggggcagagcaggcgttccgagggccagagacccacccaggtgggggtaggggccgcggaagggcggggatggccgcag

SEQ ID NO: 12321 - DNA, 42 bp, Homo sapiens
  chr15:92936971-92937013
  hyper
gttggtgggaggaggcgagcagaggcgcggagcaaagctgtc

SEQ ID NO: 12322 - DNA, 30 bp, Homo sapiens
  chr15:92937326-92937356
  hyper
cgcgctcacgctgctcgtggtcttcctcat

SEQ ID NO: 12323 - DNA, 35 bp, Homo sapiens; identical to SEQ ID NO: 4298
  chr15:92937700-92937735
  hyper

SEQ ID NO: 12324 - DNA, 293 bp, Homo sapiens; identical to SEQ ID NO: 4299
  chr15:92937736-92938029
  hyper

SEQ ID NO: 12325 - DNA, 84 bp, Homo sapiens
  chr15:93198720-93198804
  hyper
accgggtggtgttcccgggccccgggccgggcggtggccgcgactcgcgctcgggttcgggccacggcgcggagacggactcgg

SEQ ID NO: 12326 - DNA, 95 bp, Homo sapiens
  chr15:93616156-93616251
  hyper
tgcagagaaggaaggcgagggtcggccagaatcccagggctgaacgtcctgcccctctccccatacccatccatccagctcggcctgttaccact

SEQ ID NO: 12327 - DNA, 108 bp, Homo sapiens
  chr15:93616545-93616653
  hyper
gggacccaggctgcccggccgcagcgctcgccgtgaggacctcggaaaaccacggccctagatcagagggcgcgccacgctccccgaccctcgcgccatctccagccc

SEQ ID NO: 12328 - DNA, 382 bp, Homo sapiens
  chr15:93631632-93632014
  hyper
cgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctcca

SEQ ID NO: 12329 - DNA, 439 bp, Homo sapiens; identical to SEQ ID NO: 4300
  chr15:93632291-93632730
  hyper

SEQ ID NO: 12330 - DNA, 87 bp, Homo sapiens; identical to SEQ ID NO: 4301
  chr15:93632731-93632818
  hyper

SEQ ID NO: 12331 - DNA, 221 bp, Homo sapiens; identical to SEQ ID NO: 4302
  chr15:93633045-93633266
  hyper

SEQ ID NO: 12332 - DNA, 14 bp, Homo sapiens
  chr15:95388665-95388679
  hyper
ggagaagaatatct

SEQ ID NO: 12333 - DNA, 30 bp, Homo sapiens
  chr15:96865078-96865108
  hyper
ccgccacccggcggccgcccctgacaccga

SEQ ID NO: 12334 - DNA, 133 bp, Homo sapiens
  chr15:96897877-96898010
  hyper
gttccgccacgggtccgacggggcaccctgggtccccgcagcccgtcacaggcgtttgcacatttgtgtgcacgaccactggcgggggcgttgagcctctgctagccgcctcgggctccgcacacccttgggt

SEQ ID NO: 12335 - DNA, 250 bp, Homo sapiens
  chr15:96911442-96911692
  hyper
gaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcc

SEQ ID NO: 12336 - DNA, 4 bp, Homo sapiens
  chr15:96953095-96953099
  hyper
gccg

SEQ ID NO: 12337 - DNA, 36 bp, Homo sapiens
  chr15:96953131-96953167
  hyper
cgcgcggcccggagccgaccccgcctcctcttccga

SEQ ID NO: 12338 - DNA, 231 bp, Homo sapiens
  chr15:96959730-96959961
  hyper
gcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccc

SEQ ID NO: 12339 - DNA, 163 bp, Homo sapiens
  chr15:98836021-98836184
  hyper
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagcccgccc

SEQ ID NO: 12340 - DNA, 30 bp, Homo sapiens
  chr15:98965287-98965317
  hyper
ccggtgcgccgccgccgatggggtcttagg

SEQ ID NO: 12341 - DNA, 30 bp, Homo sapiens
  chr15:98971901-98971931
  hyper
ctcactgctgcaacccgggtctcagtcttc

SEQ ID NO: 12342 - DNA, 437 bp, Homo sapiens
  chr15:100881407-100881844
  hyper
gctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 12343 - DNA, 149 bp, Homo sapiens; identical to SEQ ID NO: 4303
  chr15:100913447-100913596
  hyper

SEQ ID NO: 12344 - DNA, 45 bp, Homo sapiens
  chr15:101420521-101420566
  hyper
tcgcgagtggaggtgcgcgccgcgttgactcggagcgcgctggtt

SEQ ID NO: 12345 - DNA, 70 bp, Homo sapiens
  chr16:215301-215371
  hyper
gctgagtgatgggtccgggggcttcgcaggaactcggtcgtccccactgtcgtcgcggcctggggttcac

SEQ ID NO: 12346 - DNA, 214 bp, Homo sapiens; identical to SEQ ID NO: 4304
  chr16:215659-215873
  hyper

SEQ ID NO: 12347 - DNA, 48 bp, Homo sapiens; identical to SEQ ID NO: 4305
  chr16:215912-215960
  hyper

SEQ ID NO: 12348 - DNA, 263 bp, Homo sapiens; identical to SEQ ID NO: 4306
  chr16:215961-216224
  hyper

SEQ ID NO: 12349 - DNA, 393 bp, Homo sapiens
  chr16:216583-216976
  hyper
aatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 12350 - DNA, 38 bp, Homo sapiens
  chr16:223349-223387
  hyper
atctgggtcgaggggcgagatggcgccttcctctcagg

SEQ ID NO: 12351 - DNA, 15 bp, Homo sapiens
  chr16:230301-230316
  hyper
cgattcagagggccc

SEQ ID NO: 12352 - DNA, 30 bp, Homo sapiens
  chr16:230859-230889
  hyper
cagcttccaggtgagcggctgccgtgctgg

SEQ ID NO: 12353 - DNA, 270 bp, Homo sapiens
  chr16:610046-610316
  hyper
acccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 12354 - DNA, 151 bp, Homo sapiens
  chr16:610343-610494
  hyper
cgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctc

SEQ ID NO: 12355 - DNA, 30 bp, Homo sapiens
  chr16:681006-681036
  hyper
ctggagaggaaccagcgtcacacagacggc

SEQ ID NO: 12356 - DNA, 253 bp, Homo sapiens
  chr16:725597-725850
  hyper
cgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctgg

SEQ ID NO: 12357 - DNA, 343 bp, Homo sapiens
  chr16:750505-750848
  hyper
tttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccac

SEQ ID NO: 12358 - DNA, 177 bp, Homo sapiens
  chr16:1030521-1030698
  hyper
gggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcg

SEQ ID NO: 12359 - DNA, 284 bp, Homo sapiens
  chr16:1031782-1032066
  hyper
cggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcg

SEQ ID NO: 12360 - DNA, 276 bp, Homo sapiens
  chr16:1203265-1203541
  hyper
gggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcgg

SEQ ID NO: 12361 - DNA, 50 bp, Homo sapiens
  chr16:1203913-1203963
  hyper
cgcggagctgggtgccgacgaggagcagcgcgtcccgtacccggccttgg

SEQ ID NO: 12362 - DNA, 109 bp, Homo sapiens
  chr16:1204002-1204111
  hyper
cgcgcagctggtgcctccggctggtctgcaacccatatccttcccggccggcggggggcggggggcggggggcgtggggagggtgggggcccggggcgcgggactccct

SEQ ID NO: 12363 - DNA, 103 bp, Homo sapiens
  chr16:1204128-1204231
  hyper
cgcccctgttggtgggacctggcgtgggccgggcgcgcgggggtgcagggcaggggctggaggaccgcgctctaatttctgagagtggcgggcttggggggcc

SEQ ID NO: 12364 - DNA, 248 bp, Homo sapiens
  chr16:1382374-1382622
  hyper
tgcccaggtgcccttcgggtgaaaactccaaagtctgaccaccccccaccccttgtccccaaagggctgcgagtgtccagctgtattcgaccaagggcaggtgcgaccggggggccgctgcgccctcggcaagtctgagagcctcaggcccccgacaggaccatgcttagcacggacttctcaaagtgtggtccctggactggcggcagcagactggagctgggaagtgcaggcgctggctggcgtgg

SEQ ID NO: 12365 - DNA, 65 bp, Homo sapiens
  chr16:1382901-1382966
  hyper
aaaaaagggaaaaaacgcagatcgcgcccccacccagacttcgggaccagcgggttggggacagg

SEQ ID NO: 12366 - DNA, 30 bp, Homo sapiens
  chr16:1384604-1384634
  hyper
ggagcccaaggccaccggcagcgcttgtta

SEQ ID NO: 12367 - DNA, 114 bp, Homo sapiens; identical to SEQ ID NO: 1244
  chr16:2040847-2040961
  hyper

SEQ ID NO: 12368 - DNA, 1 bp, Homo sapiens
  chr16:2040980-2040981
  hyper
c

SEQ ID NO: 12369 - DNA, 531 bp, Homo sapiens; identical to SEQ ID NO: 1246
  chr16:2040982-2041513
  hyper

SEQ ID NO: 12370 - DNA, 619 bp, Homo sapiens; identical to SEQ ID NO: 1247
  chr16:2041581-2042200
  hyper

SEQ ID NO: 12371 - DNA, 30 bp, Homo sapiens
  chr16:2070078-2070108
  hyper
ctatctgtggcgccgcgcgctgcgcgcggc

SEQ ID NO: 12372 - DNA, 76 bp, Homo sapiens
  chr16:2892527-2892603
  hyper
gctccccactgttgtcgcctctcagccccacgcccactcatccacaggcagccgggatgctcacgcagccacgtca

SEQ ID NO: 12373 - DNA, 15 bp, Homo sapiens
  chr16:2892626-2892641
  hyper
cgactctgccaacag

SEQ ID NO: 12374 - DNA, 37 bp, Homo sapiens
  chr16:3016812-3016849
  hyper
gaccaggggcctgggcgggcctcgaggtggggcctgg

SEQ ID NO: 12375 - DNA, 275 bp, Homo sapiens; identical to SEQ ID NO: 4311
  chr16:3017156-3017431
  hyper

SEQ ID NO: 12376 - DNA, 183 bp, Homo sapiens
  chr16:3068171-3068354
  hyper
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggca

SEQ ID NO: 12377 - DNA, 30 bp, Homo sapiens
  chr16:3096912-3096942
  hyper
cgcaccatgcggctgcggctccggcttctg

SEQ ID NO: 12378 - DNA, 40 bp, Homo sapiens; identical to SEQ ID NO: 4312
  chr16:3220590-3220630
  hyper

SEQ ID NO: 12379 - DNA, 560 bp, Homo sapiens; identical to SEQ ID NO: 1248
  chr16:3221141-3221701
  hyper

SEQ ID NO: 12380 - DNA, 267 bp, Homo sapiens; identical to SEQ ID NO: 1249
  chr16:3221786-3222053
  hyper

SEQ ID NO: 12381 - DNA, 15 bp, Homo sapiens
  chr16:3222113-3222128
  hyper
cgagccctagaagtg

SEQ ID NO: 12382 - DNA, 30 bp, Homo sapiens
  chr16:3224981-3225011
  hyper
ggtcctagaaaggaacgggaaaccgtcacc

SEQ ID NO: 12383 - DNA, 39 bp, Homo sapiens
  chr16:3225568-3225607
  hyper
caggcctgagggcaacgcttactgcggagcaactgtgtt

SEQ ID NO: 12384 - DNA, 376 bp, Homo sapiens; identical to SEQ ID NO: 1251
  chr16:3232641-3233017
  hyper

SEQ ID NO: 12385 - DNA, 133 bp, Homo sapiens; identical to SEQ ID NO: 1252
  chr16:3233198-3233331
  hyper

SEQ ID NO: 12386 - DNA, 670 bp, Homo sapiens; identical to SEQ ID NO: 1253
  chr16:3233434-3234104
  hyper

SEQ ID NO: 12387 - DNA, 196 bp, Homo sapiens; identical to SEQ ID NO: 1254
  chr16:3234164-3234360
  hyper

SEQ ID NO: 12388 - DNA, 164 bp, Homo sapiens; identical to SEQ ID NO: 1255
  chr16:3237900-3238064
  hyper

SEQ ID NO: 12389 - DNA, 1500 bp, Homo sapiens; identical to SEQ ID NO: 1256
  chr16:3238124-3239624
  hyper

SEQ ID NO: 12390 - DNA, 164 bp, Homo sapiens; identical to SEQ ID NO: 1257
  chr16:3239684-3239848
  hyper

SEQ ID NO: 12391 - DNA, 107 bp, Homo sapiens
  chr16:3241556-3241663
  hyper
gagccccacgttgggcgacttgttttcttccttgctaccttggagttctggaaacagccagcatttaatgaacactaccaggtgccacatcgcgctctgtgatggta

SEQ ID NO: 12392 - DNA, 25 bp, Homo sapiens
  chr16:3355209-3355234
  hyper
acccggcgaggctcccgggaccaaa

SEQ ID NO: 12393 - DNA, 468 bp, Homo sapiens
  chr16:3355250-3355718
  hyper
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagcc

SEQ ID NO: 12394 - DNA, 154 bp, Homo sapiens
  chr16:4363926-4364080
  hyper
gcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagcc

SEQ ID NO: 12395 - DNA, 329 bp, Homo sapiens
  chr16:4377992-4378321
  hyper
tctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggag

SEQ ID NO: 12396 - DNA, 201 bp, Homo sapiens
  chr16:4588308-4588509
  hyper
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcacccccccca

SEQ ID NO: 12397 - DNA, 86 bp, Homo sapiens
  chr16:5037621-5037707
  hyper
gcgagtcccgcagcccggacggggctgtgcacgtggtggagcggagctgccggctgcgcgtggacgccccgcggctgctgcggaag

SEQ ID NO: 12398 - DNA, 51 bp, Homo sapiens
  chr16:5037911-5037962
  hyper
gtagcgggaactgggcggggttcgcggggccagggccggagctgggtggtg

SEQ ID NO: 12399 - DNA, 30 bp, Homo sapiens
  chr16:6070172-6070202
  hyper
ctacccccaggaggccgagaccctgagccc

SEQ ID NO: 12400 - DNA, 30 bp, Homo sapiens
  chr16:6533480-6533510
  hyper
gaggcactttgcagccgacaatgaaatctt

SEQ ID NO: 12401 - DNA, 30 bp, Homo sapiens
  chr16:10274399-10274429
  hyper
aggctgctgggatcacggactccattccga

SEQ ID NO: 12402 - DNA, 212 bp, Homo sapiens
  chr16:10274813-10275025
  hyper
ctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 12403 - DNA, 190 bp, Homo sapiens
  chr16:10275308-10275498
  hyper
acacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggac

SEQ ID NO: 12404 - DNA, 104 bp, Homo sapiens
  chr16:10275801-10275905
  hyper
agccaccgggtttagcgggttcccgcatgctgcggccccagcgcgctcccctggctgtcccgcgctgtccgcatcgcccccacggggggcggctatcccagccg

SEQ ID NO: 12405 - DNA, 202 bp, Homo sapiens; identical to SEQ ID NO: 4323
  chr16:10276597-10276799
  hyper

SEQ ID NO: 12406 - DNA, 251 bp, Homo sapiens; identical to SEQ ID NO: 4324
  chr16:10276800-10277051
  hyper

SEQ ID NO: 12407 - DNA, 328 bp, Homo sapiens; identical to SEQ ID NO: 4325
  chr16:10277071-10277399
  hyper

SEQ ID NO: 12408 - DNA, 94 bp, Homo sapiens
  chr16:10480064-10480158
  hyper
cggccccggaggcctcggagcgccgggcctaccggacgtttgcggcgaagctgccctgactgaaaagcgtccgcggggccgtctgacaggtccg

SEQ ID NO: 12409 - DNA, 287 bp, Homo sapiens; identical to SEQ ID NO: 4326
  chr16:12994459-12994746
  hyper

SEQ ID NO: 12410 - DNA, 285 bp, Homo sapiens
  chr16:12994952-12995237
  hyper
ctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgc

SEQ ID NO: 12411 - DNA, 139 bp, Homo sapiens
  chr16:12995478-12995617
  hyper
cttcagcgcacttggcgagctggtgaggtgagagggatactgcgagagggctaggggcggccagtccggggctgccggccaaggctaggcgctgccagcccgattctcctctgctctccacccccgcctcacccagtgg

SEQ ID NO: 12412 - DNA, 591 bp, Homo sapiens
  chr16:12996242-12996833
  hyper
tgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagag

SEQ ID NO: 12413 - DNA, 289 bp, Homo sapiens
  chr16:12997414-12997703
  hyper
ccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 12414 - DNA, 63 bp, Homo sapiens
  chr16:15950853-15950916
  hyper
acgcacctcccaggccggagcgtccaaatctccctgcgcgtcctcggacgcctctctttatag

SEQ ID NO: 12415 - DNA, 338 bp, Homo sapiens
  chr16:19567111-19567449
  hyper
tacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctg

SEQ ID NO: 12416 - DNA, 30 bp, Homo sapiens
  chr16:20085391-20085421
  hyper
tagacctgggagccccgaaggaagaccgga

SEQ ID NO: 12417 - DNA, 299 bp, Homo sapiens
  chr16:21294997-21295296
  hyper
gggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 12418 - DNA, 22 bp, Homo sapiens
  chr16:21295340-21295362
  hyper
cgctggccgctgctccagacgc

SEQ ID NO: 12419 - DNA, 49 bp, Homo sapiens
  chr16:21675345-21675394
  hyper
ataggaagtcccaggcggggactgtgacccccgccgctgccctggctga

SEQ ID NO: 12420 - DNA, 323 bp, Homo sapiens
  chr16:21831608-21831931
  hyper
atcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagag

SEQ ID NO: 12421 - DNA, 83 bp, Homo sapiens
  chr16:22173801-22173884
  hyper
gagaaggaggtggcccggtggccctggcggcgcggagactggcgcagcgcggggagcacgcagcgccgcgggagcccgggcca

SEQ ID NO: 12422 - DNA, 377 bp, Homo sapiens
  chr16:22203596-22203973
  hyper
tccttttatagatgacgaaaactggggctttgtctcattccaaagagcagaggagggtgggggtttctgctctacagctgggggaatttggaggagcaccgcctaagccgccactggcctaaacacaacacgtggtaacttctactcttctacactctggccatgccaaggcttgcggttgaactctggtctcgttctctcagagccgcaaacctcggaccatttgaagctggcggtcctggggcttcctttcctctcgataacatgtttacatccaaactcacttccttcctctctttcttctccctgctaatcctgggaaatctgttcttcgagcaggaaaaacaatctcacactgctcacgttattttctagat

SEQ ID NO: 12423 - DNA, 476 bp, Homo sapiens
  chr16:22824601-22825077
  hyper
tcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctaggg

SEQ ID NO: 12424 - DNA, 143 bp, Homo sapiens; identical to SEQ ID NO: 1258
  chr16:22825327-22825470
  hyper

SEQ ID NO: 12425 - DNA, 88 bp, Homo sapiens; identical to SEQ ID NO: 4328
  chr16:22825937-22826025
  hyper

SEQ ID NO: 12426 - DNA, 30 bp, Homo sapiens
  chr16:22826278-22826308
  hyper
agccctcattgtgggcgtgaagaagggggg

SEQ ID NO: 12427 - DNA, 72 bp, Homo sapiens
  chr16:23313400-23313472
  hyper
gtatcgctggtgtcccgaggtggggagggagaatgcggagcgcgtgcgtgcggggggcgtccagtgtccctg

SEQ ID NO: 12428 - DNA, 89 bp, Homo sapiens
  chr16:23706462-23706551
  hyper
catcactctccagcccggaccttcccactcaccctccctgaaccgcaatgcaactcacctcctgcaaggaggcccggcagagctccagg

SEQ ID NO: 12429 - DNA, 30 bp, Homo sapiens
  chr16:23765970-23766000
  hyper
gtcgacgccggggagcgccctggggttggg

SEQ ID NO: 12430 - DNA, 216 bp, Homo sapiens; identical to SEQ ID NO: 1259
  chr16:23846838-23847054
  hyper

SEQ ID NO: 12431 - DNA, 15 bp, Homo sapiens
  chr16:23847310-23847325
  hyper
cggcagcagctgggc

SEQ ID NO: 12432 - DNA, 186 bp, Homo sapiens; identical to SEQ ID NO: 1261
  chr16:23847326-23847512
  hyper

SEQ ID NO: 12433 - DNA, 28 bp, Homo sapiens
  chr16:23847788-23847816
  hyper
ggactcccggctccggaccctgctgccc

SEQ ID NO: 12434 - DNA, 58 bp, Homo sapiens; identical to SEQ ID NO: 1263
  chr16:23847817-23847875
  hyper

SEQ ID NO: 12435 - DNA, 70 bp, Homo sapiens; identical to SEQ ID NO: 1264
  chr16:23847933-23848003
  hyper

SEQ ID NO: 12436 - DNA, 68 bp, Homo sapiens; identical to SEQ ID NO: 1265
  chr16:23848004-23848072
  hyper

SEQ ID NO: 12437 - DNA, 181 bp, Homo sapiens
  chr16:23848310-23848491
  hyper
cccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctct

SEQ ID NO: 12438 - DNA, 120 bp, Homo sapiens; identical to SEQ ID NO: 4336
  chr16:24267025-24267145
  hyper

SEQ ID NO: 12439 - DNA, 388 bp, Homo sapiens; identical to SEQ ID NO: 4337
  chr16:24267220-24267608
  hyper

SEQ ID NO: 12440 - DNA, 37 bp, Homo sapiens
  chr16:24621912-24621949
  hyper
ggctctggggagctgcggctctcgggccctgccaaac

SEQ ID NO: 12441 - DNA, 98 bp, Homo sapiens
  chr16:25702837-25702935
  hyper
gttgggatgggaaagcggttgtagaaaaggattcactcctggaccgaaggcaggaggatatcccgggcgagagaagggagggtcggggatgggctgag

SEQ ID NO: 12442 - DNA, 971 bp, Homo sapiens; identical to SEQ ID NO: 4338
  chr16:25703152-25704123
  hyper

SEQ ID NO: 12443 - DNA, 255 bp, Homo sapiens; identical to SEQ ID NO: 4339
  chr16:25704389-25704644
  hyper

SEQ ID NO: 12444 - DNA, 70 bp, Homo sapiens
  chr16:28074185-28074255
  hyper
gcggggcgtcccgcacgtccccccatgctggtccccggccccggaacggcgcgcgccccctgccccggaa

SEQ ID NO: 12445 - DNA, 481 bp, Homo sapiens
  chr16:28074417-28074898
  hyper
cgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccc

SEQ ID NO: 12446 - DNA, 4 bp, Homo sapiens
  chr16:31228309-31228313
  hyper
tctc

SEQ ID NO: 12447 - DNA, 30 bp, Homo sapiens
  chr16:31498683-31498713
  hyper
cgtcattctggggggcgcctgcatcctcat

SEQ ID NO: 12448 - DNA, 100 bp, Homo sapiens
  chr16:31540961-31541061
  hyper
cgggggtgcgcggggcgggggcgcggctaggaggcgccgcacagcaatcagacgcggctcagggtgcgcgcggggagctggagggcgcagttctggacct

SEQ ID NO: 12449 - DNA, 259 bp, Homo sapiens; identical to SEQ ID NO: 4341
  chr16:31580480-31580739
  hyper

SEQ ID NO: 12450 - DNA, 132 bp, Homo sapiens
  chr16:47177106-47177238
  hyper
gcggcctccgctccacgacaggaatctcacaactttgcaaagggatgcgcggaattctacggaagcggcgcgagggcgcagcccggagggccctgctgggcccaggggcctcctggccgccttcccgacccg

SEQ ID NO: 12451 - DNA, 340 bp, Homo sapiens; identical to SEQ ID NO: 4342
  chr16:49309108-49309448
  hyper

SEQ ID NO: 12452 - DNA, 523 bp, Homo sapiens; identical to SEQ ID NO: 4343
  chr16:49311467-49311990
  hyper

SEQ ID NO: 12453 - DNA, 199 bp, Homo sapiens; identical to SEQ ID NO: 4344
  chr16:49312032-49312231
  hyper

SEQ ID NO: 12454 - DNA, 347 bp, Homo sapiens; identical to SEQ ID NO: 4345
  chr16:49313363-49313710
  hyper

SEQ ID NO: 12455 - DNA, 625 bp, Homo sapiens; identical to SEQ ID NO: 4346
  chr16:49313936-49314561
  hyper

SEQ ID NO: 12456 - DNA, 38 bp, Homo sapiens
  chr16:49314784-49314822
  hyper
ccagtaacccccctacggggccagggcccggcacgagg

SEQ ID NO: 12457 - DNA, 552 bp, Homo sapiens; identical to SEQ ID NO: 1266
  chr16:49315764-49316316
  hyper

SEQ ID NO: 12458 - DNA, 35 bp, Homo sapiens
  chr16:49317700-49317735
  hyper
gactggcagctctggcggcgcgctggaggggaccg

SEQ ID NO: 12459 - DNA, 45 bp, Homo sapiens
  chr16:51183963-51184008
  hyper
cgctaggcctgggagctttgaggccggtaccgtgaaacaccttta

SEQ ID NO: 12460 - DNA, 100 bp, Homo sapiens; identical to SEQ ID NO: 4348
  chr16:51184324-51184424
  hyper

SEQ ID NO: 12461 - DNA, 188 bp, Homo sapiens; identical to SEQ ID NO: 4349
  chr16:51184770-51184958
  hyper

SEQ ID NO: 12462 - DNA, 238 bp, Homo sapiens; identical to SEQ ID NO: 4350
  chr16:51185054-51185292
  hyper

SEQ ID NO: 12463 - DNA, 423 bp, Homo sapiens; identical to SEQ ID NO: 4351
  chr16:51185542-51185965
  hyper

SEQ ID NO: 12464 - DNA, 200 bp, Homo sapiens; identical to SEQ ID NO: 4352
  chr16:51186025-51186225
  hyper

SEQ ID NO: 12465 - DNA, 100 bp, Homo sapiens
  chr16:51186595-51186695
  hyper
gggacgaggtggcggcgcagagccggaaagcggggtggggggagggcggtggggaggtgttctgtccgaggctgcctggcggcgccgaagctcgcctcca

SEQ ID NO: 12466 - DNA, 219 bp, Homo sapiens
  chr16:51186895-51187114
  hyper
tcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccg

SEQ ID NO: 12467 - DNA, 30 bp, Homo sapiens
  chr16:51189298-51189328
  hyper
ggggacgaggcacatcgatggtatcaacat

SEQ ID NO: 12468 - DNA, 72 bp, Homo sapiens
  chr16:51190143-51190215
  hyper
ccggtattaagaaaccgacttcgctagcgactgcaagtgcttgcgattttgactttccgtccacagttgagc

SEQ ID NO: 12469 - DNA, 60 bp, Homo sapiens
  chr16:54318670-54318730
  hyper
cggtggagacccccccgcgccgggaggcgagcggcgcgggttgtccgggcttgtggcagt

SEQ ID NO: 12470 - DNA, 105 bp, Homo sapiens
  chr16:54319377-54319482
  hyper
tgctctccctggtggcgttcttgggacgggacgggtccccgaactggtactggccatacgggtagaaggcggggtgcgggtgcggaaacgcggcagccgcggccg

SEQ ID NO: 12471 - DNA, 38 bp, Homo sapiens
  chr16:54321664-54321702
  hyper
cttcacggattagggcgtgcagtcgatagcggcattga

SEQ ID NO: 12472 - DNA, 176 bp, Homo sapiens; identical to SEQ ID NO: 4353
  chr16:54628691-54628867
  hyper

SEQ ID NO: 12473 - DNA, 30 bp, Homo sapiens
  chr16:54966792-54966822
  hyper
cgaccccgagggccccgaagcaggttggtg

SEQ ID NO: 12474 - DNA, 66 bp, Homo sapiens; identical to SEQ ID NO: 4354
  chr16:54967141-54967207
  hyper

SEQ ID NO: 12475 - DNA, 20 bp, Homo sapiens
  chr16:54971546-54971566
  hyper
cttagctttgaactccggcc

SEQ ID NO: 12476 - DNA, 30 bp, Homo sapiens
  chr16:54972930-54972960
  hyper
gggaaagtgagaaggcgtggtgttggcatt

SEQ ID NO: 12477 - DNA, 72 bp, Homo sapiens
  chr16:55090748-55090820
  hyper
caaaaggcagatttccgcgccgggcacctgtttgcagggctgcgcctccttccgctgcggtgttttatctcg

SEQ ID NO: 12478 - DNA, 319 bp, Homo sapiens
  chr16:55357622-55357941
  hyper
ggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgagg

SEQ ID NO: 12479 - DNA, 360 bp, Homo sapiens
  chr16:55357991-55358351
  hyper
cgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctg

SEQ ID NO: 12480 - DNA, 273 bp, Homo sapiens
  chr16:55358798-55359071
  hyper
cggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatggggga

SEQ ID NO: 12481 - DNA, 87 bp, Homo sapiens; identical to SEQ ID NO: 1267
  chr16:55363136-55363223
  hyper

SEQ ID NO: 12482 - DNA, 487 bp, Homo sapiens
  chr16:55364732-55365219
  hyper
ggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 12483 - DNA, 202 bp, Homo sapiens
  chr16:55404998-55405200
  hyper
tccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 12484 - DNA, 13 bp, Homo sapiens
  chr16:55405201-55405214
  hyper
tttctaagcagca

SEQ ID NO: 12485 - DNA, 19 bp, Homo sapiens
  chr16:55512935-55512954
  hyper
cggccggggaaaagaggtg

SEQ ID NO: 12486 - DNA, 138 bp, Homo sapiens
  chr16:55513226-55513364
  hyper
ggccggaccatgagccgctgagccgggcaaaccccaggccaccgagccagcggaccctcggagcgcagccctgcgccgcggagcaggctccaaccaggcggcgaggcggccacacgcaccgagccagcgacccccggg

SEQ ID NO: 12487 - DNA, 40 bp, Homo sapiens
  chr16:55513482-55513522
  hyper
cgtcgcccatcatcaagttccccggcgatgtcgcccccaa

SEQ ID NO: 12488 - DNA, 30 bp, Homo sapiens
  chr16:55514115-55514145
  hyper
ccttcggcacagatccggagagggaccttt

SEQ ID NO: 12489 - DNA, 178 bp, Homo sapiens
  chr16:55690202-55690380
  hyper
tggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 12490 - DNA, 124 bp, Homo sapiens
  chr16:55690453-55690577
  hyper
cgcgcgctcatcccagtgtctaaggcgctcccgggtggtcttgggagttgcaagtagggaggaacggccgggtaaccacctcttttccctttatccaagcagagcctcggcgtgcccccaggac

SEQ ID NO: 12491 - DNA, 225 bp, Homo sapiens; identical to SEQ ID NO: 4356
  chr16:56224557-56224782
  hyper

SEQ ID NO: 12492 - DNA, 10 bp, Homo sapiens
  chr16:56224783-56224793
  hyper
ggtttattcc

SEQ ID NO: 12493 - DNA, 39 bp, Homo sapiens; identical to SEQ ID NO: 4358
  chr16:56224794-56224833
  hyper

SEQ ID NO: 12494 - DNA, 89 bp, Homo sapiens; identical to SEQ ID NO: 4359
  chr16:56224880-56224969
  hyper

SEQ ID NO: 12495 - DNA, 30 bp, Homo sapiens
  chr16:56225583-56225613
  hyper
ccgcggacgcaccgacggctgaagagcggc

SEQ ID NO: 12496 - DNA, 14 bp, Homo sapiens
  chr16:56228577-56228591
  hyper
gggggaggggagtg

SEQ ID NO: 12497 - DNA, 116 bp, Homo sapiens
  chr16:56623236-56623352
  hyper
gggcgcacgcgcgggcgtgggcgagcgggccccggcagtgcacacacacggcaggggcgggcgacagatgcagtgcgtgcgccggagcccaagcgcacaaacggaaagagcgggcg

SEQ ID NO: 12498 - DNA, 167 bp, Homo sapiens
  chr16:56623702-56623869
  hyper
ggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 12499 - DNA, 84 bp, Homo sapiens
  chr16:56651238-56651322
  hyper
cgggtgccaagcaagagacccgcggtgcacaccttgcgcccggccggcctgctgctcacagtccctccacgtacccacaggagg

SEQ ID NO: 12500 - DNA, 610 bp, Homo sapiens; identical to SEQ ID NO: 1268
  chr16:56659128-56659738
  hyper

SEQ ID NO: 12501 - DNA, 44 bp, Homo sapiens
  chr16:56665985-56666029
  hyper
ccgtgttgctgtgtacggaggagccagtccgagggaccgcggtg

SEQ ID NO: 12502 - DNA, 34 bp, Homo sapiens
  chr16:56666408-56666442
  hyper
gctcaggggatggtgcgcccggcacttatgctgg

SEQ ID NO: 12503 - DNA, 30 bp, Homo sapiens; identical to SEQ ID NO: 1269
  chr16:56672513-56672543
  hyper

SEQ ID NO: 12504 - DNA, 308 bp, Homo sapiens
  chr16:56677180-56677488
  hyper
ggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagct

SEQ ID NO: 12505 - DNA, 56 bp, Homo sapiens
  chr16:56709837-56709893
  hyper
cgggccccaaaagggcggtccccgggagcccaccaggctgcactcaggggatggtg

SEQ ID NO: 12506 - DNA, 100 bp, Homo sapiens
  chr16:56709949-56710049
  hyper
cgcgtgggggtgggtgagaagggtactctgcacccggccccctcttctaactataaattgagcttccggttcctagaatccaccacgcctcccacctgcc

SEQ ID NO: 12507 - DNA, 317 bp, Homo sapiens; identical to SEQ ID NO: 4362
  chr16:58018579-58018896
  hyper

SEQ ID NO: 12508 - DNA, 271 bp, Homo sapiens; identical to SEQ ID NO: 4363
  chr16:58019164-58019435
  hyper

SEQ ID NO: 12509 - DNA, 122 bp, Homo sapiens
  chr16:58497214-58497336
  hyper
tctaaacaaagactacggcagcgccgtcccctcccccgggaacccgacgccgcgcggccacagggggcctggaggggcgggcagggcctcgcagcgcacccagcacagtccgcgcggcggag

SEQ ID NO: 12510 - DNA, 265 bp, Homo sapiens
  chr16:58497469-58497734
  hyper
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccag

SEQ ID NO: 12511 - DNA, 591 bp, Homo sapiens
  chr16:58497994-58498585
  hyper
tctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgc

SEQ ID NO: 12512 - DNA, 64 bp, Homo sapiens
  chr16:58498586-58498650
  hyper
ggagcaccggtcagggggtggccccatggggtctctgaccagcggagctcggattaggaccctg

SEQ ID NO: 12513 - DNA, 138 bp, Homo sapiens
  chr16:62069136-62069274
  hyper
cgcgaccagcccctcaaaggttcccggatgagaagcggccagaccacagaaagcgcaggtctgggctcagctgtccctaggagagcggctacggagtccccggcttaagggggcctccgtgcacgcaatctcgagttg

SEQ ID NO: 12514 - DNA, 35 bp, Homo sapiens
  chr16:62069336-62069371
  hyper
cgcagggcgactccggagcccggcaagtttgtagc

SEQ ID NO: 12515 - DNA, 30 bp, Homo sapiens
  chr16:62070756-62070786
  hyper
cccgcagctattttccgtaggaggaagagg

SEQ ID NO: 12516 - DNA, 172 bp, Homo sapiens
  chr16:65155754-65155926
  hyper
agaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctc

SEQ ID NO: 12517 - DNA, 30 bp, Homo sapiens
  chr16:65156359-65156389
  hyper
tccttcccccaaatccgctccagctggcca

SEQ ID NO: 12518 - DNA, 23 bp, Homo sapiens
  chr16:65156872-65156895
  hyper
aagggcctaatggggcgcagcgc

SEQ ID NO: 12519 - DNA, 132 bp, Homo sapiens
  chr16:65157154-65157286
  hyper
aggcaagagaggaggcggaggaaggtggagacgccagtgggtgaaggctaaaaaggaaccgcctagggggacggggatgaggctgggaaaggagaagagatggacccgcgaaaaagacggggaaggaggctg

SEQ ID NO: 12520 - DNA, 15 bp, Homo sapiens
  chr16:65157823-65157838
  hyper
gtaaccccccaacct

SEQ ID NO: 12521 - DNA, 262 bp, Homo sapiens; identical to SEQ ID NO: 4364
  chr16:66461578-66461840
  hyper

SEQ ID NO: 12522 - DNA, 185 bp, Homo sapiens
  chr16:66612882-66613067
  hyper
cgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtga

SEQ ID NO: 12523 - DNA, 36 bp, Homo sapiens
  chr16:66638302-66638338
  hyper
cccggatcccagacacgcgcacgggcaggaagttag

SEQ ID NO: 12524 - DNA, 32 bp, Homo sapiens
  chr16:66878288-66878320
  hyper
tttaagaggctgctccgcggtagcgagcgggg

SEQ ID NO: 12525 - DNA, 106 bp, Homo sapiens
  chr16:66878819-66878925
  hyper
tgcggggagcgcgcacggcaagtgagcggggacctcgggggagcggggctccgcgtggcaagggcgcagtgtcccccggagagaatttccccgcagaagtggccga

SEQ ID NO: 12526 - DNA, 605 bp, Homo sapiens
  chr16:67197667-67198272
  hyper
ataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgc

SEQ ID NO: 12527 - DNA, 146 bp, Homo sapiens
  chr16:67198775-67198921
  hyper
tcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcc

SEQ ID NO: 12528 - DNA, 51 bp, Homo sapiens
  chr16:67199411-67199462
  hyper
gcgttcttggtagagcgggaccagtttcctcgtaagcgaccagagccgttt

SEQ ID NO: 12529 - DNA, 45 bp, Homo sapiens
  chr16:68118410-68118455
  hyper
gccacccaatttaggcggctccatccctcccgctttcatggatat

SEQ ID NO: 12530 - DNA, 98 bp, Homo sapiens
  chr16:68118803-68118901
  hyper
ggatgaggatgtgggcggcgtccaggtaactctgaggggccctgatgccttccctagagccagccatcaggagtaacacgatgcgcccccacatcacc

SEQ ID NO: 12531 - DNA, 69 bp, Homo sapiens
  chr16:68504068-68504137
  hyper
gtaaaggaagcaacacggaacaaccacgtttttgttattcgaaatgcagctacacgtgtttacagtcct

SEQ ID NO: 12532 - DNA, 119 bp, Homo sapiens
  chr16:68544259-68544378
  hyper
tacgggcctcagctgcgcagcgcagacggaggagggcgctggcggttaagaactcctacttgtcaaccggaaaaacatcccccataaaaaaacggtcaaagggccgggacagaagcatt

SEQ ID NO: 12533 - DNA, 245 bp, Homo sapiens; identical to SEQ ID NO: 4365
  chr16:68676360-68676605
  hyper

SEQ ID NO: 12534 - DNA, 15 bp, Homo sapiens
  chr16:68676841-68676856
  hyper
cgtggtccaccccca

SEQ ID NO: 12535 - DNA, 110 bp, Homo sapiens; identical to SEQ ID NO: 1270
  chr16:71459979-71460089
  hyper

SEQ ID NO: 12536 - DNA, 81 bp, Homo sapiens; identical to SEQ ID NO: 1271
  chr16:71460270-71460351
  hyper

SEQ ID NO: 12537 - DNA, 72 bp, Homo sapiens
  chr16:75528797-75528869
  hyper
tgtggggacatcccccgcggagaatgaagaaccaacgtaccccaaagcttggcggctctgcccgagctgcag

SEQ ID NO: 12538 - DNA, 207 bp, Homo sapiens
  chr16:75528922-75529129
  hyper
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacag

SEQ ID NO: 12539 - DNA, 208 bp, Homo sapiens
  chr16:77246657-77246865
  hyper
ggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgag

SEQ ID NO: 12540 - DNA, 48 bp, Homo sapiens
  chr16:77469028-77469076
  hyper
gggctcgtccgagcccccgggctggtgcaagggcgtgggattcccggc

SEQ ID NO: 12541 - DNA, 85 bp, Homo sapiens; identical to SEQ ID NO: 4369
  chr16:77822334-77822419
  hyper

SEQ ID NO: 12542 - DNA, 688 bp, Homo sapiens; identical to SEQ ID NO: 4370
  chr16:77822420-77823108
  hyper

SEQ ID NO: 12543 - DNA, 57 bp, Homo sapiens
  chr16:78079844-78079901
  hyper
aggccgggcaatgggcgcggagacgaaggggccggacagcggcgaggcgctggctcc

SEQ ID NO: 12544 - DNA, 83 bp, Homo sapiens
  chr16:79632686-79632769
  hyper
aaactcgggagaggacgggttgtcgctgctcgagccgttttctcggaagccgctgctcaccaacttctcgtatttctccttgt

SEQ ID NO: 12545 - DNA, 38 bp, Homo sapiens
  chr16:79633490-79633528
  hyper
ggggttcagctgctgcgggtagccggtcatccagtagt

SEQ ID NO: 12546 - DNA, 153 bp, Homo sapiens
  chr16:80574886-80575039
  hyper
tttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcg

SEQ ID NO: 12547 - DNA, 64 bp, Homo sapiens
  chr16:82660432-82660496
  hyper
gcggggctcgctcctcgcgaggtgctcaccccgtatctgccatgcaaaacgagggagcgttagg

SEQ ID NO: 12548 - DNA, 136 bp, Homo sapiens
  chr16:82661468-82661604
  hyper
cggccagatcccgggctgccgcctctgctgccttccctgagcgggagcggagcgcagagaaaagttcaagccttgcccacccgggctgcagctgcttgttaaccctcagagcgccacggcgcgagggaagggcacg

SEQ ID NO: 12549 - DNA, 49 bp, Homo sapiens
  chr16:84633325-84633374
  hyper
actttacagagactccggagaggttatgcaaacacggctcaggaaggga

SEQ ID NO: 12550 - DNA, 30 bp, Homo sapiens
  chr16:85203552-85203582
  hyper
ctacgcgctgggcagcgccaccggcgacga

SEQ ID NO: 12551 - DNA, 228 bp, Homo sapiens
  chr16:85932377-85932605
  hyper
gcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccg

SEQ ID NO: 12552 - DNA, 127 bp, Homo sapiens
  chr16:85932828-85932955
  hyper
ggtaggcacagtgggcgggtagggcgcccgtgtcccgcgcggtccggtcccgcggggtccccgacgccaggcggggcgtgggggtggaactacctaccgtaatgtccccgggcgcagctcagtggcc

SEQ ID NO: 12553 - DNA, 30 bp, Homo sapiens
  chr16:86320396-86320426
  hyper
tccagggacccaagacggggatctgggagg

SEQ ID NO: 12554 - DNA, 152 bp, Homo sapiens; identical to SEQ ID NO: 4371
  chr16:86320901-86321053
  hyper

SEQ ID NO: 12555 - DNA, 46 bp, Homo sapiens; identical to SEQ ID NO: 4372
  chr16:86530947-86530993
  hyper

SEQ ID NO: 12556 - DNA, 273 bp, Homo sapiens; identical to SEQ ID NO: 4373
  chr16:86531016-86531289
  hyper

SEQ ID NO: 12557 - DNA, 107 bp, Homo sapiens; identical to SEQ ID NO: 4374
  chr16:86531374-86531481
  hyper

SEQ ID NO: 12558 - DNA, 93 bp, Homo sapiens; identical to SEQ ID NO: 4375
  chr16:86531527-86531620
  hyper

SEQ ID NO: 12559 - DNA, 42 bp, Homo sapiens
  chr16:86539385-86539427
  hyper
ggcggccccctgccccgcccgcgcggccggcctgggctccct

SEQ ID NO: 12560 - DNA, 15 bp, Homo sapiens
  chr16:86539463-86539478
  hyper
cgctctcggcccggg

SEQ ID NO: 12561 - DNA, 50 bp, Homo sapiens
  chr16:86542388-86542438
  hyper
cgtgcgagccccctgcgggctggcagccaggtgcgcgagggccgcccttg

SEQ ID NO: 12562 - DNA, 44 bp, Homo sapiens
  chr16:86544243-86544287
  hyper
cgcggccatggaccccgcgtcgtccggcccgtccaaggccaaga

SEQ ID NO: 12563 - DNA, 56 bp, Homo sapiens; identical to SEQ ID NO: 1272
  chr16:86544502-86544558
  hyper

SEQ ID NO: 12564 - DNA, 364 bp, Homo sapiens; identical to SEQ ID NO: 1273
  chr16:86599480-86599844
  hyper

SEQ ID NO: 12565 - DNA, 336 bp, Homo sapiens
  chr16:86600322-86600658
  hyper
cctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgg

SEQ ID NO: 12566 - DNA, 64 bp, Homo sapiens
  chr16:86600877-86600941
  hyper
cccccctcgctcccccggccgcagtccgtgcgcgagggcgccggcgagccgtctcggaagcagc

SEQ ID NO: 12567 - DNA, 205 bp, Homo sapiens
  chr16:86602037-86602242
  hyper
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaacca

SEQ ID NO: 12568 - DNA, 46 bp, Homo sapiens
  chr16:86602455-86602501
  hyper
gggacctcccctccccggcccgctccggcttcgcttcccagccccg

SEQ ID NO: 12569 - DNA, 84 bp, Homo sapiens
  chr16:86775022-86775106
  hyper
cctccctgcgggagccgctgctagagggaaaggcagcgttggatcggatgccggccccagcctgggagacgtgcttcctctgca

SEQ ID NO: 12570 - DNA, 63 bp, Homo sapiens
  chr16:87635070-87635133
  hyper
cagtttctggctcaccgcgctgcggtcaccggcccacactcccaggagcgaggaccctgggca

SEQ ID NO: 12571 - DNA, 156 bp, Homo sapiens
  chr16:87636626-87636782
  hyper
ggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgac

SEQ ID NO: 12572 - DNA, 492 bp, Homo sapiens
  chr16:87636783-87637275
  hyper
acggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaa

SEQ ID NO: 12573 - DNA, 54 bp, Homo sapiens
  chr16:87637599-87637653
  hyper
cgaatctgcccaagccgagagaaagggagtgatggggagcgctaggggcggggg

SEQ ID NO: 12574 - DNA, 42 bp, Homo sapiens
  chr16:88449331-88449373
  hyper
gtctgtaacctaagccgccccagcctccggggggcagacccc

SEQ ID NO: 12575 - DNA, 215 bp, Homo sapiens
  chr16:88449705-88449920
  hyper
ccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccgg

SEQ ID NO: 12576 - DNA, 65 bp, Homo sapiens
  chr16:88450363-88450428
  hyper
ggctcgggggactcccgcggccacccagtccttgtccctgcaccctgggccgagggcagagggac

SEQ ID NO: 12577 - DNA, 222 bp, Homo sapiens
  chr16:89007509-89007731
  hyper
tggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaa

SEQ ID NO: 12578 - DNA, 162 bp, Homo sapiens
  chr16:89267663-89267825
  hyper
gcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 12579 - DNA, 30 bp, Homo sapiens
  chr16:89992943-89992973
  hyper
cctggcctcgaacgccgggttctgctttgt

SEQ ID NO: 12580 - DNA, 57 bp, Homo sapiens
  chr17:1083604-1083661
  hyper
cccgggatctccaagcgcggcttcgcgggcgggagcggcggccgggcccctccccag

SEQ ID NO: 12581 - DNA, 29 bp, Homo sapiens
  chr17:1174333-1174362
  hyper
cctcgcgcgcccagacgccgcccgcccct

SEQ ID NO: 12582 - DNA, 45 bp, Homo sapiens
  chr17:1928077-1928122
  hyper
cggcgcccgggctcgcggctctttccggagcgcattcaacttcaa

SEQ ID NO: 12583 - DNA, 71 bp, Homo sapiens
  chr17:1959436-1959507
  hyper
gggccccgaccgagggttgacagcccccggccagggcggcgccagggcgggcaccgcgctcccctcctccg

SEQ ID NO: 12584 - DNA, 477 bp, Homo sapiens
  chr17:2627798-2628275
  hyper
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctcc

SEQ ID NO: 12585 - DNA, 41 bp, Homo sapiens
  chr17:2652548-2652589
  hyper
gccagcagcccgccgcgagtcctgtccgcctcccgcgcgct

SEQ ID NO: 12586 - DNA, 30 bp, Homo sapiens
  chr17:2659635-2659665
  hyper
cgccctttccccctccgcagtcctggcccg

SEQ ID NO: 12587 - DNA, 118 bp, Homo sapiens
  chr17:2756282-2756400
  hyper
tgggcgcggggagggcggagtggggggcgcccggcccgccaggaggaagcggggtcgccgtgaagttggttattgaacccatgtggagtcaaactcccagggccgggagagccagtgt

SEQ ID NO: 12588 - DNA, 36 bp, Homo sapiens
  chr17:3438902-3438938
  hyper
agaaggcccccttggcgtgcgcgttgacgtcggcgc

SEQ ID NO: 12589 - DNA, 59 bp, Homo sapiens
  chr17:3867044-3867103
  hyper
ggccagctgggaggccgagcctgagtctccggccgtccctcgcccgccggtgtctgcgc

SEQ ID NO: 12590 - DNA, 230 bp, Homo sapiens
  chr17:4544550-4544780
  hyper
ttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgc

SEQ ID NO: 12591 - DNA, 41 bp, Homo sapiens
  chr17:4981508-4981549
  hyper
ccgttctaggaaacccggaggactcaggtcgtcaatgattc

SEQ ID NO: 12592 - DNA, 4 bp, Homo sapiens
  chr17:4981951-4981955
  hyper
cgtt

SEQ ID NO: 12593 - DNA, 95 bp, Homo sapiens; identical to SEQ ID NO: 4378
  chr17:5000401-5000496
  hyper

SEQ ID NO: 12594 - DNA, 46 bp, Homo sapiens
  chr17:5001155-5001201
  hyper
gctctggggcgtccgcggaggctcccgcgtgcgtgtgcggggtggg

SEQ ID NO: 12595 - DNA, 62 bp, Homo sapiens
  chr17:6616271-6616333
  hyper
gatctgtgctcacttcgaggtttccgtgcttgcctggacggctcttgcgccctgggatctgt

SEQ ID NO: 12596 - DNA, 246 bp, Homo sapiens; identical to SEQ ID NO: 4379
  chr17:6616637-6616883
  hyper

SEQ ID NO: 12597 - DNA, 174 bp, Homo sapiens; identical to SEQ ID NO: 4380
  chr17:6616884-6617058
  hyper

SEQ ID NO: 12598 - DNA, 32 bp, Homo sapiens
  chr17:6679763-6679795
  hyper
gccaactccccctcccgcggtgggtaggacat

SEQ ID NO: 12599 - DNA, 36 bp, Homo sapiens
  chr17:6926208-6926244
  hyper
ttgtttctgaggtcccgccctcgagacggagacccc

SEQ ID NO: 12600 - DNA, 41 bp, Homo sapiens
  chr17:7554709-7554750
  hyper
ggggtctcctttgcccgcgccgccttcgctccccgtgcttt

SEQ ID NO: 12601 - DNA, 30 bp, Homo sapiens
  chr17:8055644-8055674
  hyper
agatgcctacctggtcgcaggagtgtcctc

SEQ ID NO: 12602 - DNA, 378 bp, Homo sapiens
  chr17:8230404-8230782
  hyper
cccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttga

SEQ ID NO: 12603 - DNA, 48 bp, Homo sapiens; identical to SEQ ID NO: 1274
  chr17:8868620-8868668
  hyper

SEQ ID NO: 12604 - DNA, 399 bp, Homo sapiens; identical to SEQ ID NO: 1275
  chr17:8868814-8869213
  hyper

SEQ ID NO: 12605 - DNA, 171 bp, Homo sapiens; identical to SEQ ID NO: 1276
  chr17:8869214-8869385
  hyper

SEQ ID NO: 12606 - DNA, 288 bp, Homo sapiens
  chr17:8906385-8906673
  hyper
cgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcg

SEQ ID NO: 12607 - DNA, 181 bp, Homo sapiens
  chr17:8906907-8907088
  hyper
cggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgg

SEQ ID NO: 12608 - DNA, 434 bp, Homo sapiens; identical to SEQ ID NO: 1277
  chr17:8907294-8907728
  hyper

SEQ ID NO: 12609 - DNA, 22 bp, Homo sapiens
  chr17:8907776-8907798
  hyper
cgggtgacggaggctttatcct

SEQ ID NO: 12610 - DNA, 63 bp, Homo sapiens
  chr17:8925622-8925685
  hyper
cgcaggcgccttctgcggcaggcggacagatcctcggcgcggcagggccggggcaagctggac

SEQ ID NO: 12611 - DNA, 15 bp, Homo sapiens
  chr17:10101095-10101110
  hyper
actccggggtggaga

SEQ ID NO: 12612 - DNA, 317 bp, Homo sapiens; identical to SEQ ID NO: 1280
  chr17:10101131-10101448
  hyper

SEQ ID NO: 12613 - DNA, 319 bp, Homo sapiens
  chr17:10102318-10102637
  hyper
cactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatg

SEQ ID NO: 12614 - DNA, 245 bp, Homo sapiens
  chr17:10633034-10633279
  hyper
cgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctc

SEQ ID NO: 12615 - DNA, 34 bp, Homo sapiens
  chr17:13503911-13503945
  hyper
gcacgtcggggtgcacgcgcaggaactccagcag

SEQ ID NO: 12616 - DNA, 95 bp, Homo sapiens
  chr17:13504557-13504652
  hyper
gtgcgcccctgtggccgtgcgaactgtcccgggaggcagcggccggggctccgcggggaaacggaatcccgggggccccgcgcaggatccctgcc

SEQ ID NO: 12617 - DNA, 91 bp, Homo sapiens
  chr17:13505001-13505092
  hyper
cgcccgagttcaggttctctcagccaaggagcgaggtccccccgagtccctctgcccgagcgggagacaggaggcccgtgcagagccgtcc

SEQ ID NO: 12618 - DNA, 106 bp, Homo sapiens; identical to SEQ ID NO: 4388
  chr17:13505466-13505572
  hyper

SEQ ID NO: 12619 - DNA, 173 bp, Homo sapiens
  chr17:14201008-14201181
  hyper
ggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcagg

SEQ ID NO: 12620 - DNA, 149 bp, Homo sapiens
  chr17:14203122-14203271
  hyper
gtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 12621 - DNA, 115 bp, Homo sapiens
  chr17:14204011-14204126
  hyper
catctgggcaactaccgccaaggctggcttctagggaacgagtgcggaaatgcgtgcgggtgtgggagcgcaccactcagtagggtaggacctctcccagcgctaggtcactgca

SEQ ID NO: 12622 - DNA, 447 bp, Homo sapiens
  chr17:14205251-14205698
  hyper
ggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaa

SEQ ID NO: 12623 - DNA, 30 bp, Homo sapiens
  chr17:14206313-14206343
  hyper
aagggacagtggccccggggtcacaatcac

SEQ ID NO: 12624 - DNA, 30 bp, Homo sapiens
  chr17:15164652-15164682
  hyper
acccaactctgccagcgtagaggaacggtc

SEQ ID NO: 12625 - DNA, 66 bp, Homo sapiens
  chr17:15166283-15166349
  hyper
actaatagagggcagcgggcgcttgagcgctggaagaagtccctctcctctcgggtcctggagccc

SEQ ID NO: 12626 - DNA, 92 bp, Homo sapiens
  chr17:15166709-15166801
  hyper
ttcatagcctcctaacgtggcccgcccagcgttacagggagagaggctagcccccttcagtctcggcttggcagaggcgcgcccaactgaga

SEQ ID NO: 12627 - DNA, 145 bp, Homo sapiens
  chr17:15244987-15245132
  hyper
cggccgccccggccggctcgccggagctgactggccagttataggagaggcgggagctgtcaggccaggagggaaacccgtcgggcggcggttactatggacgcgctcacgcttagtaaccgaggctccccgccctccgggagac

SEQ ID NO: 12628 - DNA, 35 bp, Homo sapiens
  chr17:15820977-15821012
  hyper
cccaggctgcggctccgcgccggtgacgggggctc

SEQ ID NO: 12629 - DNA, 213 bp, Homo sapiens
  chr17:16472191-16472404
  hyper
gagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttcc

SEQ ID NO: 12630 - DNA, 204 bp, Homo sapiens
  chr17:16570699-16570903
  hyper
aggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccac

SEQ ID NO: 12631 - DNA, 74 bp, Homo sapiens
  chr17:17398902-17398976
  hyper
ggcaagacttggtgtcgaggatctgctgcctgagccgctgcacctcctcgaaggagtcgcggttgtccagactg

SEQ ID NO: 12632 - DNA, 41 bp, Homo sapiens
  chr17:18538205-18538246
  hyper
cccacgcctctgctcgctcacccgcccggctgccttagggg

SEQ ID NO: 12633 - DNA, 40 bp, Homo sapiens
  chr17:19437028-19437068
  hyper
gaggtgcaaggggcgcgcccaaggtcgcaggctgcctggc

SEQ ID NO: 12634 - DNA, 51 bp, Homo sapiens
  chr17:19483136-19483187
  hyper
cgggacggggaggggcggggctgggtgggatcgggtcgcccccctcacccc

SEQ ID NO: 12635 - DNA, 30 bp, Homo sapiens
  chr17:20755963-20755993
  hyper
agacgcgtctcccttcgggcaaagtgactg

SEQ ID NO: 12636 - DNA, 34 bp, Homo sapiens
  chr17:26120627-26120661
  hyper
gcagcagtcaggcttcggccggaggatcctgcag

SEQ ID NO: 12637 - DNA, 197 bp, Homo sapiens
  chr17:26554556-26554753
  hyper
ggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctc

SEQ ID NO: 12638 - DNA, 178 bp, Homo sapiens
  chr17:26554791-26554969
  hyper
cgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcg

SEQ ID NO: 12639 - DNA, 46 bp, Homo sapiens
  chr17:26578387-26578433
  hyper
ctggagggggcagggcggacagagccgcgggcggtcacgtgacccc

SEQ ID NO: 12640 - DNA, 242 bp, Homo sapiens
  chr17:27332453-27332695
  hyper
cgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgc

SEQ ID NO: 12641 - DNA, 311 bp, Homo sapiens
  chr17:27940590-27940901
  hyper
cgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtc

SEQ ID NO: 12642 - DNA, 629 bp, Homo sapiens
  chr17:27949499-27950128
  hyper
gctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 12643 - DNA, 30 bp, Homo sapiens
  chr17:28562797-28562827
  hyper
cttgaagaatttttgcgtcactttgaggcg

SEQ ID NO: 12644 - DNA, 91 bp, Homo sapiens
  chr17:28705348-28705439
  hyper
taaaaatgaatgcaccgcctagtgaggtgcgagccttcctccccacgaggcgtcccgtgcaaccgcacgcggacagcggggctccagcgga

SEQ ID NO: 12645 - DNA, 289 bp, Homo sapiens; identical to SEQ ID NO: 4389
  chr17:29249650-29249939
  hyper

SEQ ID NO: 12646 - DNA, 229 bp, Homo sapiens
  chr17:29718142-29718371
  hyper
ctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcc

SEQ ID NO: 12647 - DNA, 412 bp, Homo sapiens
  chr17:29718805-29719217
  hyper
gcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttc

SEQ ID NO: 12648 - DNA, 64 bp, Homo sapiens
  chr17:30846542-30846606
  hyper
caacgccggccccagcgcccgcggctgaaacgaagccgctgcccgagcccgagcgccagcgcac

SEQ ID NO: 12649 - DNA, 118 bp, Homo sapiens; identical to SEQ ID NO: 1281
  chr17:31618291-31618409
  hyper

SEQ ID NO: 12650 - DNA, 344 bp, Homo sapiens; identical to SEQ ID NO: 1282
  chr17:31618410-31618754
  hyper

SEQ ID NO: 12651 - DNA, 383 bp, Homo sapiens; identical to SEQ ID NO: 4392
  chr17:31618954-31619337
  hyper

SEQ ID NO: 12652 - DNA, 464 bp, Homo sapiens
  chr17:31619687-31620151
  hyper
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctc

SEQ ID NO: 12653 - DNA, 57 bp, Homo sapiens
  chr17:32906021-32906078
  hyper
agctgggcacagcagcgaggctgattcccagccagtgcccagcgaactctgggggtg

SEQ ID NO: 12654 - DNA, 153 bp, Homo sapiens
  chr17:32907265-32907418
  hyper
ctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggg

SEQ ID NO: 12655 - DNA, 85 bp, Homo sapiens; identical to SEQ ID NO: 4393
  chr17:32907620-32907705
  hyper

SEQ ID NO: 12656 - DNA, 99 bp, Homo sapiens; identical to SEQ ID NO: 4394
  chr17:32907706-32907805
  hyper

SEQ ID NO: 12657 - DNA, 274 bp, Homo sapiens; identical to SEQ ID NO: 4395
  chr17:32907873-32908147
  hyper

SEQ ID NO: 12658 - DNA, 204 bp, Homo sapiens; identical to SEQ ID NO: 4396
  chr17:32908170-32908374
  hyper

SEQ ID NO: 12659 - DNA, 349 bp, Homo sapiens; identical to SEQ ID NO: 4397
  chr17:32908582-32908931
  hyper

SEQ ID NO: 12660 - DNA, 301 bp, Homo sapiens
  chr17:33700472-33700773
  hyper
gtgctgctcccttctcgaacctggcactcgagttacagcccgacgcggattcggctgggctagaccctgaagcacgggtagaaacgcaactccggagtcccaggctgggggcaaggaccctctctgacctctcaagctccagcgcttccgaagcccccttagcgtttccctggaggcgcccaggtcgagtccttatatactagcgggttggcgccatcccacgcacatcccacgcaggagatgcaagagccaatgggcgggtctgctaagcccgcgaactctgccgcgttaaattgcctag

SEQ ID NO: 12661 - DNA, 402 bp, Homo sapiens
  chr17:33700974-33701376
  hyper
ggcccaagcagctgtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtca

SEQ ID NO: 12662 - DNA, 44 bp, Homo sapiens
  chr17:33775400-33775444
  hyper
ggaacacagatagcccgccaagccgccggcgacaccttccaacc

SEQ ID NO: 12663 - DNA, 347 bp, Homo sapiens
  chr17:35014262-35014609
  hyper
gggcggaggacgcagcgggcggcctgcggaggcggcctggctcggggtgggggctcggccggagttcccgcggctgctcggcggcggccggctcgggagcaaccttgagcgcggtcgcggaggcagtgatttaggtgccggcaccggagcgtgaaggtaaatggccacatttcaccgtcgggaggtgagccggaggcgcccgccctggcccttcccccaaggccccgggccggtgggggcgggagttttgcttcccctctctgacccgctccgaggcccgcctgggagggcggcgcccccacggtgcaggacaggagggctgcgccgggctgcggggtgagcaagac

SEQ ID NO: 12664 - DNA, 341 bp, Homo sapiens
  chr17:35078546-35078887
  hyper
acggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctc

SEQ ID NO: 12665 - DNA, 98 bp, Homo sapiens
  chr17:35165593-35165691
  hyper
cttcaattttatcagcggccggggagccgggcgggagataggaggccggccctgacacgaattagcccggagattgtccgatacgccttggccagggc

SEQ ID NO: 12666 - DNA, 30 bp, Homo sapiens
  chr17:35165897-35165927
  hyper
ccgggtcacctgggccgatccaggcgggca

SEQ ID NO: 12667 - DNA, 358 bp, Homo sapiens
  chr17:35285437-35285795
  hyper
cctcccttcatccatcgcggaaggagcagcgggggggctggccctctcagccccgagagcagagagcggcagaagctgttaattcttgaggctaatgttcacatctccaacttatctctccgaggggaagtgtccatttgaccacatgatcctccctcccctaccctcccccaaggggaaatcaaatcttgaagtgagaccggaagagctgctgcggaacgtgagcacgggagagctggtgggggtagaaggcggtgaggggccgaaaggctcctcaaacccagtttctttccatgctaaggctggggaaataacctcatggcaactacactttccgataacccgcctcattaatatt

SEQ ID NO: 12668 - DNA, 288 bp, Homo sapiens
  chr17:35290388-35290676
  hyper
aaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactct

SEQ ID NO: 12669 - DNA, 70 bp, Homo sapiens
  chr17:35291829-35291899
  hyper
ggagcccagctgggacgggggcggaggcaagccacccgggactggggccactatagattccagaaagggg

SEQ ID NO: 12670 - DNA, 101 bp, Homo sapiens
  chr17:35291920-35292021
  hyper
cggcgagaaccgggacagctgcggggaggggaggagtgtgaggacagcagggctggactggccccctccccgcaggcctcacgcagcgcagcaggctggga

SEQ ID NO: 12671 - DNA, 48 bp, Homo sapiens
  chr17:35292273-35292321
  hyper
ctgactagtcccctacgctcctccggcccgcagcggggagcccacatg

SEQ ID NO: 12672 - DNA, 30 bp, Homo sapiens
  chr17:35292596-35292626
  hyper
attccatctgcacagcgggattccctgcca

SEQ ID NO: 12673 - DNA, 475 bp, Homo sapiens; identical to SEQ ID NO: 4398
  chr17:35294006-35294481
  hyper

SEQ ID NO: 12674 - DNA, 9 bp, Homo sapiens
  chr17:35294482-35294491
  hyper
gggctgtgc

SEQ ID NO: 12675 - DNA, 1133 bp, Homo sapiens; identical to SEQ ID NO: 4400
  chr17:35294492-35295625
  hyper

SEQ ID NO: 12676 - DNA, 30 bp, Homo sapiens
  chr17:35296016-35296046
  hyper
cattctccaggccttcggggttgtttgccc

SEQ ID NO: 12677 - DNA, 85 bp, Homo sapiens
  chr17:35296253-35296338
  hyper
ctgcactgtagcctgcgaagtgcccggagctttttcctgcttccctggctgccgaagttgtctggtggttcggcttcagccccag

SEQ ID NO: 12678 - DNA, 430 bp, Homo sapiens; identical to SEQ ID NO: 4401
  chr17:35296716-35297146
  hyper

SEQ ID NO: 12679 - DNA, 90 bp, Homo sapiens; identical to SEQ ID NO: 4402
  chr17:35297147-35297237
  hyper

SEQ ID NO: 12680 - DNA, 228 bp, Homo sapiens; identical to SEQ ID NO: 1283
  chr17:35297936-35298164
  hyper

SEQ ID NO: 12681 - DNA, 259 bp, Homo sapiens; identical to SEQ ID NO: 1284
  chr17:35299185-35299444
  hyper

SEQ ID NO: 12682 - DNA, 89 bp, Homo sapiens; identical to SEQ ID NO: 1285
  chr17:35299600-35299689
  hyper

SEQ ID NO: 12683 - DNA, 56 bp, Homo sapiens; identical to SEQ ID NO: 1286
  chr17:35299910-35299966
  hyper

SEQ ID NO: 12684 - DNA, 453 bp, Homo sapiens; identical to SEQ ID NO: 1287
  chr17:35300260-35300713
  hyper

SEQ ID NO: 12685 - DNA, 30 bp, Homo sapiens; identical to SEQ ID NO: 1288
  chr17:35300812-35300842
  hyper

SEQ ID NO: 12686 - DNA, 210 bp, Homo sapiens; identical to SEQ ID NO: 1289
  chr17:35303325-35303535
  hyper

SEQ ID NO: 12687 - DNA, 75 bp, Homo sapiens
  chr17:36102404-36102479
  hyper
tttctctttgcttttcgtcttaagggaacacggtgggcaaaagaagggagtgcgtgtgcccgaggcttgggagcc

SEQ ID NO: 12688 - DNA, 280 bp, Homo sapiens
  chr17:36102707-36102987
  hyper
ctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtat

SEQ ID NO: 12689 - DNA, 63 bp, Homo sapiens
  chr17:36103226-36103289
  hyper
ccccggcagccctggcgccccagccgctcctaggggccactctctcgacccctcttagcctcc

SEQ ID NO: 12690 - DNA, 36 bp, Homo sapiens
  chr17:36103290-36103326
  hyper
cgactcacaccttccgcctcgcggaactctcttgca

SEQ ID NO: 12691 - DNA, 63 bp, Homo sapiens; identical to SEQ ID NO: 4410
  chr17:36103540-36103603
  hyper

SEQ ID NO: 12692 - DNA, 334 bp, Homo sapiens; identical to SEQ ID NO: 4411
  chr17:36104217-36104551
  hyper

SEQ ID NO: 12693 - DNA, 189 bp, Homo sapiens; identical to SEQ ID NO: 4412
  chr17:36104643-36104832
  hyper

SEQ ID NO: 12694 - DNA, 213 bp, Homo sapiens; identical to SEQ ID NO: 4413
  chr17:36105137-36105350
  hyper

SEQ ID NO: 12695 - DNA, 254 bp, Homo sapiens; identical to SEQ ID NO: 4414
  chr17:36105458-36105712
  hyper

SEQ ID NO: 12696 - DNA, 327 bp, Homo sapiens; identical to SEQ ID NO: 4415
  chr17:37321298-37321625
  hyper

SEQ ID NO: 12697 - DNA, 78 bp, Homo sapiens; identical to SEQ ID NO: 4416
  chr17:37321787-37321865
  hyper

SEQ ID NO: 12698 - DNA, 462 bp, Homo sapiens; identical to SEQ ID NO: 4417
  chr17:37366090-37366552
  hyper

SEQ ID NO: 12699 - DNA, 423 bp, Homo sapiens; identical to SEQ ID NO: 1290
  chr17:37381007-37381430
  hyper

SEQ ID NO: 12700 - DNA, 157 bp, Homo sapiens; identical to SEQ ID NO: 1291
  chr17:37381570-37381727
  hyper

SEQ ID NO: 12701 - DNA, 292 bp, Homo sapiens; identical to SEQ ID NO: 1292
  chr17:37381825-37382117
  hyper

SEQ ID NO: 12702 - DNA, 59 bp, Homo sapiens
  chr17:37752878-37752937
  hyper
tcctctcctcctccccgcactggccgcgtaggtggcctcgggtgcggaggtcccggcct

SEQ ID NO: 12703 - DNA, 144 bp, Homo sapiens
  chr17:37753194-37753338
  hyper
gcggcgtggcagtggcggctcccagcgcggagggaaccattgggcgctgttcggacctcttcccttgtgtccttccttcccttctcccgcatccactcactcccatctctccactgtctatgtccttctcgacctctgccccac

SEQ ID NO: 12704 - DNA, 85 bp, Homo sapiens
  chr17:37760446-37760531
  hyper
aggggacagaatggccgcggggaggaggagccggcgagctcacctccttctgccccccggacgccggcgccgggcctgcttgtgc

SEQ ID NO: 12705 - DNA, 30 bp, Homo sapiens
  chr17:37761235-37761265
  hyper
tcaagaaagagggagcgcctggctcctttt

SEQ ID NO: 12706 - DNA, 1294 bp, Homo sapiens
  chr17:37761486-37762780
  hyper
tggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 12707 - DNA, 51 bp, Homo sapiens
  chr17:37856662-37856713
  hyper
cgagctctcctatcccgaagttgtggacagtcgagacgctcagggcagccg

SEQ ID NO: 12708 - DNA, 42 bp, Homo sapiens
  chr17:38478791-38478833
  hyper
ggagtggctttatcccggccctccccccggagcctctgtccc

SEQ ID NO: 12709 - DNA, 52 bp, Homo sapiens
  chr17:40332871-40332923
  hyper
cctccgtcccactcacgcgttccgtcaaaacgggtggcgatggtgtccagga

SEQ ID NO: 12710 - DNA, 188 bp, Homo sapiens
  chr17:40464190-40464378
  hyper
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtccc

SEQ ID NO: 12711 - DNA, 49 bp, Homo sapiens
  chr17:40912947-40912996
  hyper
ctggagagtcctgggcgccacgcagccgagcccccgaaatagatcccgg

SEQ ID NO: 12712 - DNA, 49 bp, Homo sapiens
  chr17:40932774-40932823
  hyper
tggccctgcggcccccgcctcctcttggcaccgcggggcagccccgcct

SEQ ID NO: 12713 - DNA, 59 bp, Homo sapiens
  chr17:40932843-40932902
  hyper
cgcgccgcttctccgggaaggctgagccccggccgcgctcttctcgtctcagccgccgt

SEQ ID NO: 12714 - DNA, 30 bp, Homo sapiens
  chr17:41984002-41984032
  hyper
gccagaggatggggtcgaaaggccaggcgg

SEQ ID NO: 12715 - DNA, 70 bp, Homo sapiens
  chr17:41984440-41984510
  hyper
gcgcaacctctgtctcgctccccaacccccggaagcgctaacagcacggttcttacgtaatgccgggctt

SEQ ID NO: 12716 - DNA, 122 bp, Homo sapiens
  chr17:42030329-42030451
  hyper
caggtctgggccctccgacctgcggaagcgaaggggaaggaattggatctggggaggcgagcctgggagacgtcgttaagtgatgttgccagggtagggccaggccgcgctctcggatgcag

SEQ ID NO: 12717 - DNA, 63 bp, Homo sapiens
  chr17:42030688-42030751
  hyper
agtggcgcagggaggcgtagtagcggttcagctcctccggcgaggcgtcttcgcggggagcct

SEQ ID NO: 12718 - DNA, 65 bp, Homo sapiens
  chr17:42061257-42061322
  hyper
ccgggctgagtgttccgaggcgagcggctgctgtttgcgcagctaagtggcgtctgtgtacccag

SEQ ID NO: 12719 - DNA, 35 bp, Homo sapiens
  chr17:42082522-42082557
  hyper
aggcatggcaggatacgctgcgggctctgcgcagc

SEQ ID NO: 12720 - DNA, 130 bp, Homo sapiens
  chr17:42083143-42083273
  hyper
tctgggaggccaaggcgcagctggccaagagctgcaaggtgctggtagacgcgcttcgacacaacgccgccgctgctgtgccattttttggcggcgggtctgtgctacgcgctgccgagccggctcccca

SEQ ID NO: 12721 - DNA, 79 bp, Homo sapiens
  chr17:42083525-42083604
  hyper
cgtcgctggccaaggcgctgcggcccaccaaaatcatcttcctcaataacacaggcggcctgcgcgacagcagtcataa

SEQ ID NO: 12722 - DNA, 30 bp, Homo sapiens
  chr17:42393545-42393575
  hyper
cccaatatttgtgcacgaatccctgtcacc

SEQ ID NO: 12723 - DNA, 196 bp, Homo sapiens; identical to SEQ ID NO: 4421
  chr17:42393910-42394106
  hyper

SEQ ID NO: 12724 - DNA, 466 bp, Homo sapiens; identical to SEQ ID NO: 1293
  chr17:42635294-42635760
  hyper

SEQ ID NO: 12725 - DNA, 343 bp, Homo sapiens; identical to SEQ ID NO: 4423
  chr17:42733556-42733899
  hyper

SEQ ID NO: 12726 - DNA, 30 bp, Homo sapiens
  chr17:42906618-42906648
  hyper
taaaccatacattcacgtacatcttttcaa

SEQ ID NO: 12727 - DNA, 123 bp, Homo sapiens
  chr17:42907014-42907137
  hyper
ggggcggcccggctccgccctgcgcccctaaccgcccgggtagttgtcggcaccgccggggcgccgccgagtgcgcgccgcttctgtccgggctccccgaccgtcgcccgacacctccgcggc

SEQ ID NO: 12728 - DNA, 416 bp, Homo sapiens
  chr17:42907735-42908151
  hyper
cgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 12729 - DNA, 80 bp, Homo sapiens
  chr17:42988684-42988764
  hyper
tactcctgcaagtggcgggccatctcgtccttgaggctctgcccctcttcctccagccgcgccagcgcctcctgataact

SEQ ID NO: 12730 - DNA, 228 bp, Homo sapiens
  chr17:43045038-43045266
  hyper
cgtggtgtaggtggcagtgctgatggcgccgctgccccccgcgcccggcagccccggagggcccggcttgcctggctcacccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggc

SEQ ID NO: 12731 - DNA, 133 bp, Homo sapiens
  chr17:43045371-43045504
  hyper
cgagctcaccagcacggggatgagcaccaccagcaccagcagcatcaccacacccgcggcggccgctagcagcgtctttcggcccgcgcggagcctggggagcgccgggccgcccggccgcgccgtcggggca

SEQ ID NO: 12732 - DNA, 96 bp, Homo sapiens; identical to SEQ ID NO: 1294
  chr17:43047752-43047848
  hyper

SEQ ID NO: 12733 - DNA, 222 bp, Homo sapiens
  chr17:43339111-43339333
  hyper
ccctactccaaggcgcgcatgcgtgtccgtgagagcacatgggtgtgcaccgcgcaggggctgaggctgggagccgtagtcaggggcaccgggtgggctttggcggcgggtcgacctgcctttcaggtgccgggggtttgggagcaggggaacgggccctgggcggattcctgaccgcccccttcgcgcccctccccctctcactttcgctttccccgcctg

SEQ ID NO: 12734 - DNA, 258 bp, Homo sapiens; identical to SEQ ID NO: 4425
  chr17:43339641-43339899
  hyper

SEQ ID NO: 12735 - DNA, 127 bp, Homo sapiens; identical to SEQ ID NO: 4426
  chr17:43974231-43974358
  hyper

SEQ ID NO: 12736 - DNA, 56 bp, Homo sapiens
  chr17:44919159-44919215
  hyper
gaccttgagcaaccacgtcctcctctgagctccgcgtttgccgtgtgcaaagtgaa

SEQ ID NO: 12737 - DNA, 35 bp, Homo sapiens
  chr17:44928630-44928665
  hyper
aatctcctccgtccccgcctcgtaccctcctcccc

SEQ ID NO: 12738 - DNA, 30 bp, Homo sapiens
  chr17:44929262-44929292
  hyper
cagcttccccggctccgaatccatcgccct

SEQ ID NO: 12739 - DNA, 100 bp, Homo sapiens
  chr17:44929573-44929673
  hyper
ggctgttcccggtctcggggcagaggatcgtgcgcgtccagggagaatgggggaaacctcggacggtgagagcgccagctggagacgcaggaaggaaccg

SEQ ID NO: 12740 - DNA, 34 bp, Homo sapiens
  chr17:45055871-45055905
  hyper
cgccgcgtccccgcccgggcgccccaggcacgta

SEQ ID NO: 12741 - DNA, 49 bp, Homo sapiens
  chr17:45056144-45056193
  hyper
acagcacgcagagcacggcgatctgcgccacccgcgacacccacaggct

SEQ ID NO: 12742 - DNA, 569 bp, Homo sapiens; identical to SEQ ID NO: 4427
  chr17:45810772-45811341
  hyper

SEQ ID NO: 12743 - DNA, 114 bp, Homo sapiens
  chr17:45867029-45867143
  hyper
ttgtactttcaaccacgtcccccactccaaaattctgcgcctccctcaagccagttcctcctctgcttcctcctcgcagcagccggcgcgtctttgttccgtccaggcatcttc

SEQ ID NO: 12744 - DNA, 30 bp, Homo sapiens
  chr17:45867454-45867484
  hyper
tgtgcactcaaagaccgccagctctggggg

SEQ ID NO: 12745 - DNA, 811 bp, Homo sapiens; identical to SEQ ID NO: 4428
  chr17:46620623-46621434
  hyper

SEQ ID NO: 12746 - DNA, 155 bp, Homo sapiens
  chr17:46621856-46622011
  hyper
accccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcag

SEQ ID NO: 12747 - DNA, 324 bp, Homo sapiens; identical to SEQ ID NO: 1295
  chr17:46655070-46655394
  hyper

SEQ ID NO: 12748 - DNA, 24 bp, Homo sapiens
  chr17:46655395-46655419
  hyper
gcgcaggagcccgaggggacagac

SEQ ID NO: 12749 - DNA, 111 bp, Homo sapiens; identical to SEQ ID NO: 1297
  chr17:46655450-46655561
  hyper

SEQ ID NO: 12750 - DNA, 437 bp, Homo sapiens; identical to SEQ ID NO: 1298
  chr17:46655562-46655999
  hyper

SEQ ID NO: 12751 - DNA, 341 bp, Homo sapiens; identical to SEQ ID NO: 1299
  chr17:46656057-46656398
  hyper

SEQ ID NO: 12752 - DNA, 480 bp, Homo sapiens; identical to SEQ ID NO: 4434
  chr17:46659429-46659909
  hyper

SEQ ID NO: 12753 - DNA, 75 bp, Homo sapiens
  chr17:46663552-46663627
  hyper
agacaagagaggagacgcctaaatcactgagaaaaggaataagaagagagggaagagaaacgttaaaacttgggg

SEQ ID NO: 12754 - DNA, 198 bp, Homo sapiens
  chr17:46670978-46671176
  hyper
tagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatgggg

SEQ ID NO: 12755 - DNA, 45 bp, Homo sapiens
  chr17:46671384-46671429
  hyper
ggcctctgagcagagcgcgccacctcccggcgaccgacgggagcg

SEQ ID NO: 12756 - DNA, 37 bp, Homo sapiens; identical to SEQ ID NO: 4435
  chr17:46674933-46674970
  hyper

SEQ ID NO: 12757 - DNA, 393 bp, Homo sapiens; identical to SEQ ID NO: 4436
  chr17:46675170-46675563
  hyper

SEQ ID NO: 12758 - DNA, 297 bp, Homo sapiens
  chr17:46687941-46688238
  hyper
ctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctgg

SEQ ID NO: 12759 - DNA, 40 bp, Homo sapiens
  chr17:46688577-46688617
  hyper
ccgcgggctggaggccgcttgcaggcgagatttggggagg

SEQ ID NO: 12760 - DNA, 225 bp, Homo sapiens
  chr17:46689986-46690211
  hyper
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaa

SEQ ID NO: 12761 - DNA, 238 bp, Homo sapiens; identical to SEQ ID NO: 4437
  chr17:46690467-46690705
  hyper

SEQ ID NO: 12762 - DNA, 28 bp, Homo sapiens
  chr17:46690852-46690880
  hyper
cgcctgcgtccggcggctgctgggaatg

SEQ ID NO: 12763 - DNA, 52 bp, Homo sapiens
  chr17:46691505-46691557
  hyper
aagaaaggggaaaagcggcaggcgatcggaacggagccggcaagtcttccag

SEQ ID NO: 12764 - DNA, 6 bp, Homo sapiens
  chr17:46691813-46691819
  hyper
aattgc

SEQ ID NO: 12765 - DNA, 378 bp, Homo sapiens; identical to SEQ ID NO: 4440
  chr17:46691987-46692365
  hyper

SEQ ID NO: 12766 - DNA, 34 bp, Homo sapiens
  chr17:46710956-46710990
  hyper
gccctcgcccagaagcgagggtccgagtggccac

SEQ ID NO: 12767 - DNA, 171 bp, Homo sapiens
  chr17:46713959-46714130
  hyper
cccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 12768 - DNA, 154 bp, Homo sapiens
  chr17:46714131-46714285
  hyper
ccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgat

SEQ ID NO: 12769 - DNA, 938 bp, Homo sapiens; identical to SEQ ID NO: 1300
  chr17:46795436-46796374
  hyper

SEQ ID NO: 12770 - DNA, 55 bp, Homo sapiens; identical to SEQ ID NO: 1301
  chr17:46796498-46796553
  hyper

SEQ ID NO: 12771 - DNA, 25 bp, Homo sapiens
  chr17:46796613-46796638
  hyper
cagcactactaccgtctgagcaggc

SEQ ID NO: 12772 - DNA, 74 bp, Homo sapiens; identical to SEQ ID NO: 4444
  chr17:46797140-46797214
  hyper

SEQ ID NO: 12773 - DNA, 31 bp, Homo sapiens; identical to SEQ ID NO: 4445
  chr17:46797274-46797305
  hyper

SEQ ID NO: 12774 - DNA, 196 bp, Homo sapiens
  chr17:46797533-46797729
  hyper
gtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 12775 - DNA, 32 bp, Homo sapiens
  chr17:46799421-46799453
  hyper
aggtcctgcaggtcccgcgtgctgcgaaacat

SEQ ID NO: 12776 - DNA, 30 bp, Homo sapiens
  chr17:46799842-46799872
  hyper
ggcgctctgtttgcacgccttaggctagga

SEQ ID NO: 12777 - DNA, 197 bp, Homo sapiens; identical to SEQ ID NO: 4446
  chr17:46800518-46800715
  hyper

SEQ ID NO: 12778 - DNA, 87 bp, Homo sapiens; identical to SEQ ID NO: 4447
  chr17:46800961-46801048
  hyper

SEQ ID NO: 12779 - DNA, 169 bp, Homo sapiens; identical to SEQ ID NO: 4448
  chr17:46801108-46801277
  hyper

SEQ ID NO: 12780 - DNA, 606 bp, Homo sapiens; identical to SEQ ID NO: 1303
  chr17:46802306-46802912
  hyper

SEQ ID NO: 12781 - DNA, 117 bp, Homo sapiens; identical to SEQ ID NO: 1304
  chr17:46802993-46803110
  hyper

SEQ ID NO: 12782 - DNA, 318 bp, Homo sapiens; identical to SEQ ID NO: 1305
  chr17:46804107-46804425
  hyper

SEQ ID NO: 12783 - DNA, 315 bp, Homo sapiens
  chr17:46805609-46805924
  hyper
ccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctc

SEQ ID NO: 12784 - DNA, 728 bp, Homo sapiens; identical to SEQ ID NO: 4452
  chr17:46810368-46811096
  hyper

SEQ ID NO: 12785 - DNA, 146 bp, Homo sapiens
  chr17:46811354-46811500
  hyper
tctttctctcatctccgttttacttcccttcctccgcccgccacacacgtttttcctttgcagcgctctcgcccagtttttccattgttcttctctgaagtctggaaagggcctgcggggctatagctctcagcggccggagcctg

SEQ ID NO: 12786 - DNA, 53 bp, Homo sapiens
  chr17:46815930-46815983
  hyper
aggccaagctttggacgagggaaagcacagactgacgccgaccagcccatcct

SEQ ID NO: 12787 - DNA, 213 bp, Homo sapiens; identical to SEQ ID NO: 4453
  chr17:46816511-46816724
  hyper

SEQ ID NO: 12788 - DNA, 347 bp, Homo sapiens; identical to SEQ ID NO: 1306
  chr17:46824568-46824915
  hyper

SEQ ID NO: 12789 - DNA, 469 bp, Homo sapiens; identical to SEQ ID NO: 1307
  chr17:46824916-46825385
  hyper

SEQ ID NO: 12790 - DNA, 63 bp, Homo sapiens; identical to SEQ ID NO: 4456
  chr17:46826997-46827060
  hyper

SEQ ID NO: 12791 - DNA, 121 bp, Homo sapiens; identical to SEQ ID NO: 4457
  chr17:46827381-46827502
  hyper

SEQ ID NO: 12792 - DNA, 49 bp, Homo sapiens; identical to SEQ ID NO: 4458
  chr17:46827625-46827674
  hyper

SEQ ID NO: 12793 - DNA, 157 bp, Homo sapiens; identical to SEQ ID NO: 4459
  chr17:46829979-46830136
  hyper

SEQ ID NO: 12794 - DNA, 502 bp, Homo sapiens; identical to SEQ ID NO: 1308
  chr17:46831824-46832326
  hyper

SEQ ID NO: 12795 - DNA, 150 bp, Homo sapiens; identical to SEQ ID NO: 1309
  chr17:46832489-46832639
  hyper

SEQ ID NO: 12796 - DNA, 324 bp, Homo sapiens
  chr17:47072705-47073029
  hyper
ctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggc

SEQ ID NO: 12797 - DNA, 225 bp, Homo sapiens
  chr17:47073103-47073328
  hyper
cgcgtgcccccgctagaattatcctccctcccacagagtccggagtaacaccccagttttcgccctgttcaaggggattccagaatttctgggggtcgacccctcctttttccccgttccctgggcgagggggttccagggtctccgggccgcgctctcggccacccctggcgccatcccagcctccgccgctagaaactcgttggcctcgctcgccgctccgcc

SEQ ID NO: 12798 - DNA, 148 bp, Homo sapiens
  chr17:47073388-47073536
  hyper
cgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggaccc

SEQ ID NO: 12799 - DNA, 320 bp, Homo sapiens
  chr17:47074089-47074409
  hyper
aaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 12800 - DNA, 198 bp, Homo sapiens; identical to SEQ ID NO: 4462
  chr17:47074751-47074949
  hyper

SEQ ID NO: 12801 - DNA, 177 bp, Homo sapiens; identical to SEQ ID NO: 1310
  chr17:47075225-47075402
  hyper

SEQ ID NO: 12802 - DNA, 35 bp, Homo sapiens
  chr17:47075700-47075735
  hyper
ttaggcctttccaggcgtggaaggggtacccggac

SEQ ID NO: 12803 - DNA, 176 bp, Homo sapiens
  chr17:47075879-47076055
  hyper
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaa

SEQ ID NO: 12804 - DNA, 68 bp, Homo sapiens
  chr17:47081200-47081268
  hyper
ccttttaaaggggagcggctggagtctcacagtgttacccacgggagaggggtcggagacgggtggta

SEQ ID NO: 12805 - DNA, 184 bp, Homo sapiens
  chr17:47210040-47210224
  hyper
tgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcg

SEQ ID NO: 12806 - DNA, 292 bp, Homo sapiens
  chr17:47573694-47573986
  hyper
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcg

SEQ ID NO: 12807 - DNA, 985 bp, Homo sapiens
  chr17:47574269-47575254
  hyper
tggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 12808 - DNA, 116 bp, Homo sapiens
  chr17:47928213-47928329
  hyper
atgattttattccttcgaaggagcgctggtctcctggccccctctcagtctcccgacctcgccagcgccagagccatcctgcatggtcccgacctcgtcagcgccagagccgtcct

SEQ ID NO: 12809 - DNA, 589 bp, Homo sapiens; identical to SEQ ID NO: 4464
  chr17:47987525-47988114
  hyper

SEQ ID NO: 12810 - DNA, 89 bp, Homo sapiens
  chr17:48041152-48041241
  hyper
gtgtgtctgtgtgtgcgcgcgcgcgctctgtgttgtattgtgtgcgctagtgcacgcattgtcttcgatgttgccgctagaggaacctt

SEQ ID NO: 12811 - DNA, 49 bp, Homo sapiens
  chr17:48041672-48041721
  hyper
agacaccctcaaaaccgcctcattttttgttaaccgttttctctctctc

SEQ ID NO: 12812 - DNA, 102 bp, Homo sapiens
  chr17:48042039-48042141
  hyper
caatccctgagaaagcgctcaggggcttgctgaggtgagcgcaaatggaagcacaaggccgggctggccgtgggctcagtaaccagtcggctgcccggcttg

SEQ ID NO: 12813 - DNA, 239 bp, Homo sapiens; identical to SEQ ID NO: 1311
  chr17:48042409-48042648
  hyper

SEQ ID NO: 12814 - DNA, 206 bp, Homo sapiens; identical to SEQ ID NO: 1312
  chr17:48042750-48042956
  hyper

SEQ ID NO: 12815 - DNA, 243 bp, Homo sapiens
  chr17:48049004-48049247
  hyper
tccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgacc

SEQ ID NO: 12816 - DNA, 1027 bp, Homo sapiens; identical to SEQ ID NO: 1313
  chr17:48049499-48050526
  hyper

SEQ ID NO: 12817 - DNA, 222 bp, Homo sapiens
  chr17:48070683-48070905
  hyper
gtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggc

SEQ ID NO: 12818 - DNA, 53 bp, Homo sapiens; identical to SEQ ID NO: 4468
  chr17:48071806-48071859
  hyper

SEQ ID NO: 12819 - DNA, 34 bp, Homo sapiens
  chr17:48619216-48619250
  hyper
cgtcccccaccaacccgttcggcgcgggcgagcc

SEQ ID NO: 12820 - DNA, 534 bp, Homo sapiens; identical to SEQ ID NO: 4469
  chr17:48636701-48637235
  hyper

SEQ ID NO: 12821 - DNA, 127 bp, Homo sapiens
  chr17:50235922-50236049
  hyper
ccggggactggggcgcggtgggggcacacagactctccaggtcgcgcgcgcccttcctgctcctctgctattttcctgaactccccagaacccccagttgcctggcttccatcgcccgcaactagcg

SEQ ID NO: 12822 - DNA, 197 bp, Homo sapiens; identical to SEQ ID NO: 4470
  chr17:53341227-53341424
  hyper

SEQ ID NO: 12823 - DNA, 43 bp, Homo sapiens
  chr17:53342876-53342919
  hyper
atcccacctttatcccgcctccctacggcgtgctcaggtccct

SEQ ID NO: 12824 - DNA, 37 bp, Homo sapiens
  chr17:53343353-53343390
  hyper
gtgcggggcagggggcgggggtcggcttgagggaggg

SEQ ID NO: 12825 - DNA, 275 bp, Homo sapiens
  chr17:53922719-53922994
  hyper
cacttcagcctcttccgtctccgtggtgcagccaggccctagcgtctctccatccccgttccccgcgggctcccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcgg

SEQ ID NO: 12826 - DNA, 30 bp, Homo sapiens
  chr17:54674012-54674042
  hyper
cctgacactgctcagcgctctctttattta

SEQ ID NO: 12827 - DNA, 77 bp, Homo sapiens
  chr17:54675060-54675137
  hyper
cccacttggaaaacccgcccgcagccggcgagcttctcggctttcagagcaggagccggtgtgagctgggaggacgc

SEQ ID NO: 12828 - DNA, 134 bp, Homo sapiens
  chr17:54675138-54675272
  hyper
ggttgcagacgtgaccggcgacagacagaccaccggatgcacagaaccagagagcaggcccgaagccgctgcggccgcgggagaggacccagcgggacccaggcagtcccagaagctaacgaaggaagtgctgg

SEQ ID NO: 12829 - DNA, 171 bp, Homo sapiens
  chr17:56234399-56234570
  hyper
atgagaaggggccagcggtggcggtcgggccaggtccggggcctggggacgccgaggcggccgcggaggagcgccgcgtcaaggtctccagcctgccctacagtgtggatgcgctcgtgtcggacaagaagccgcccaaggaggcatccccagtgccggccaaaagcgcct

SEQ ID NO: 12830 - DNA, 33 bp, Homo sapiens
  chr17:56326929-56326962
  hyper
gaagcctgcgctgggcgccgccaacagggctct

SEQ ID NO: 12831 - DNA, 463 bp, Homo sapiens
  chr17:56832946-56833409
  hyper
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagcta

SEQ ID NO: 12832 - DNA, 425 bp, Homo sapiens
  chr17:58212827-58213252
  hyper
ggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcagga

SEQ ID NO: 12833 - DNA, 247 bp, Homo sapiens
  chr17:58216590-58216837
  hyper
gcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggac

SEQ ID NO: 12834 - DNA, 70 bp, Homo sapiens; identical to SEQ ID NO: 4471
  chr17:58217229-58217299
  hyper

SEQ ID NO: 12835 - DNA, 249 bp, Homo sapiens; identical to SEQ ID NO: 4472
  chr17:58217356-58217605
  hyper

SEQ ID NO: 12836 - DNA, 383 bp, Homo sapiens
  chr17:58218674-58219057
  hyper
cgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 12837 - DNA, 294 bp, Homo sapiens
  chr17:58227104-58227398
  hyper
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagaggactctttgctgtcccgcaagatg

SEQ ID NO: 12838 - DNA, 200 bp, Homo sapiens; identical to SEQ ID NO: 4473
  chr17:58498777-58498977
  hyper

SEQ ID NO: 12839 - DNA, 355 bp, Homo sapiens; identical to SEQ ID NO: 4474
  chr17:58498978-58499333
  hyper

SEQ ID NO: 12840 - DNA, 30 bp, Homo sapiens
  chr17:59467481-59467511
  hyper
cccctagtgccgggccggccgcgcatgagg

SEQ ID NO: 12841 - DNA, 71 bp, Homo sapiens; identical to SEQ ID NO: 4475
  chr17:59474176-59474247
  hyper

SEQ ID NO: 12842 - DNA, 403 bp, Homo sapiens; identical to SEQ ID NO: 4476
  chr17:59474741-59475144
  hyper

SEQ ID NO: 12843 - DNA, 229 bp, Homo sapiens
  chr17:59475736-59475965
  hyper
cccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctcccc

SEQ ID NO: 12844 - DNA, 411 bp, Homo sapiens
  chr17:59476254-59476665
  hyper
gcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgccca

SEQ ID NO: 12845 - DNA, 30 bp, Homo sapiens
  chr17:59476876-59476906
  hyper
caaggccccgggacccgggctcccctcgcc

SEQ ID NO: 12846 - DNA, 32 bp, Homo sapiens
  chr17:59477323-59477355
  hyper
ggcccagcccggccccgcgcagagcccccgcc

SEQ ID NO: 12847 - DNA, 414 bp, Homo sapiens; identical to SEQ ID NO: 1314
  chr17:59478133-59478547
  hyper

SEQ ID NO: 12848 - DNA, 146 bp, Homo sapiens
  chr17:59488278-59488424
  hyper
acattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 12849 - DNA, 275 bp, Homo sapiens; identical to SEQ ID NO: 1315
  chr17:59528876-59529151
  hyper

SEQ ID NO: 12850 - DNA, 12 bp, Homo sapiens
  chr17:59529253-59529265
  hyper
cgacctcgggac

SEQ ID NO: 12851 - DNA, 233 bp, Homo sapiens; identical to SEQ ID NO: 1317
  chr17:59529843-59530076
  hyper

SEQ ID NO: 12852 - DNA, 49 bp, Homo sapiens; identical to SEQ ID NO: 4481
  chr17:59530303-59530352
  hyper

SEQ ID NO: 12853 - DNA, 207 bp, Homo sapiens; identical to SEQ ID NO: 4482
  chr17:59531811-59532018
  hyper

SEQ ID NO: 12854 - DNA, 170 bp, Homo sapiens; identical to SEQ ID NO: 1318
  chr17:59533874-59534044
  hyper

SEQ ID NO: 12855 - DNA, 66 bp, Homo sapiens; identical to SEQ ID NO: 1319
  chr17:59534340-59534406
  hyper

SEQ ID NO: 12856 - DNA, 225 bp, Homo sapiens; identical to SEQ ID NO: 1320
  chr17:59534556-59534781
  hyper

SEQ ID NO: 12857 - DNA, 63 bp, Homo sapiens
  chr17:59535204-59535267
  hyper
cgaggggaggggcagcgctatgcaaatgaatccaaacagggatcgcgacgctcaaaagtccca

SEQ ID NO: 12858 - DNA, 462 bp, Homo sapiens
  chr17:59539215-59539677
  hyper
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcc

SEQ ID NO: 12859 - DNA, 153 bp, Homo sapiens
  chr17:60705777-60705930
  hyper
cctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtg

SEQ ID NO: 12860 - DNA, 21 bp, Homo sapiens
  chr17:61778053-61778074
  hyper
cccgccgccaggggccgcccc

SEQ ID NO: 12861 - DNA, 15 bp, Homo sapiens
  chr17:61778234-61778249
  hyper
ggtatgcgtggttcc

SEQ ID NO: 12862 - DNA, 153 bp, Homo sapiens; identical to SEQ ID NO: 4488
  chr17:61926172-61926325
  hyper

SEQ ID NO: 12863 - DNA, 96 bp, Homo sapiens; identical to SEQ ID NO: 4489
  chr17:61926507-61926603
  hyper

SEQ ID NO: 12864 - DNA, 129 bp, Homo sapiens
  chr17:62777021-62777150
  hyper
caacagggcctttcccggagcaacccggccgggcctggaaaaactccgagagggattcccagcgcagggacgcccaccggagcgcagtgtctcgggctggataagaaggggacccggccacagctcctt

SEQ ID NO: 12865 - DNA, 45 bp, Homo sapiens
  chr17:64961987-64962032
  hyper
ccgagtctcccccaacggagacagcgacctcggtcgcggcccctc

SEQ ID NO: 12866 - DNA, 223 bp, Homo sapiens
  chr17:66596302-66596525
  hyper
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagag

SEQ ID NO: 12867 - DNA, 165 bp, Homo sapiens
  chr17:66596728-66596893
  hyper
ggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtg

SEQ ID NO: 12868 - DNA, 30 bp, Homo sapiens
  chr17:66597456-66597486
  hyper
cccccacccactctccgctggcacctgcct

SEQ ID NO: 12869 - DNA, 281 bp, Homo sapiens
  chr17:70112842-70113123
  hyper
tgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccag

SEQ ID NO: 12870 - DNA, 21 bp, Homo sapiens
  chr17:70113546-70113567
  hyper
cttccacaagaaactcgtgtc

SEQ ID NO: 12871 - DNA, 372 bp, Homo sapiens; identical to SEQ ID NO: 1322
  chr17:70113647-70114019
  hyper

SEQ ID NO: 12872 - DNA, 365 bp, Homo sapiens; identical to SEQ ID NO: 1323
  chr17:70114152-70114517
  hyper

SEQ ID NO: 12873 - DNA, 640 bp, Homo sapiens; identical to SEQ ID NO: 1324
  chr17:70215667-70216307
  hyper

SEQ ID NO: 12874 - DNA, 54 bp, Homo sapiens; identical to SEQ ID NO: 1325
  chr17:70216392-70216446
  hyper

SEQ ID NO: 12875 - DNA, 136 bp, Homo sapiens
  chr17:71161797-71161933
  hyper
cgaggggagcgaggccgtgagatgccagctggggctcctgcgggagcgcacccggagatccgagcctgccagaggcaggcggcgggcgcagagcggagaaagaggggcttctctccctagacgctgaacgatctag

SEQ ID NO: 12876 - DNA, 41 bp, Homo sapiens
  chr17:71641056-71641097
  hyper
gacgcgggctgtcgccggcgcccgggcgcagagcctcctgc

SEQ ID NO: 12877 - DNA, 140 bp, Homo sapiens
  chr17:71641497-71641637
  hyper
agccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctc

SEQ ID NO: 12878 - DNA, 57 bp, Homo sapiens
  chr17:71897984-71898041
  hyper
cacctgattacgctgcgcggacacaacagaggcgcccggacccgcagccctgccttc

SEQ ID NO: 12879 - DNA, 525 bp, Homo sapiens; identical to SEQ ID NO: 4495
  chr17:71948390-71948915
  hyper

SEQ ID NO: 12880 - DNA, 62 bp, Homo sapiens
  chr17:71949206-71949268
  hyper
ccacgggagttcacacgctccagtccatcggcctcccccggcccgaccgccctggctcaggc

SEQ ID NO: 12881 - DNA, 30 bp, Homo sapiens
  chr17:72208638-72208668
  hyper
accccatcactccaccgcacctacccctga

SEQ ID NO: 12882 - DNA, 115 bp, Homo sapiens
  chr17:72270332-72270447
  hyper
gctccggggtccttccgcgtcgccccgcgcgtccggagccaggccggggttgccaagcaaccggtaaacgccgccgtttgaggagcaccggagccgcgaccgtggattgaacgct

SEQ ID NO: 12883 - DNA, 210 bp, Homo sapiens
  chr17:72322348-72322558
  hyper
gcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 12884 - DNA, 15 bp, Homo sapiens
  chr17:72322611-72322626
  hyper
cgccaccccactgag

SEQ ID NO: 12885 - DNA, 324 bp, Homo sapiens; identical to SEQ ID NO: 4496
  chr17:72856941-72857265
  hyper

SEQ ID NO: 12886 - DNA, 127 bp, Homo sapiens
  chr17:72889569-72889696
  hyper
agctcgtcctcaccacgtcctgcaccagcacctccagctcccgcagcagcgcctcgcccccacggtgcgcgctccgcgccggttccatgggctccgtaggttccatgggctccgtgggttccatgga

SEQ ID NO: 12887 - DNA, 93 bp, Homo sapiens
  chr17:72920958-72921051
  hyper
ctcttctacctcctccgaaccgtgcgctgcccctgcgcggtaccctaccgggacgcgcacgctggccccatctggctccgaggtgccagggga

SEQ ID NO: 12888 - DNA, 59 bp, Homo sapiens
  chr17:72932027-72932086
  hyper
ggcctcaggtaagcccggagcgccggcggaactttcccagcttgcgcaccccagacact

SEQ ID NO: 12889 - DNA, 173 bp, Homo sapiens
  chr17:72932356-72932529
  hyper
gcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccga

SEQ ID NO: 12890 - DNA, 87 bp, Homo sapiens
  chr17:73073597-73073684
  hyper
gtgcctggagtgggacgacaacgcgcagaccgtgctgcacggcgcctaccaccgcacgctgggcgtggcgctcgactgcgacgccgg

SEQ ID NO: 12891 - DNA, 110 bp, Homo sapiens
  chr17:74070370-74070480
  hyper
tgggcgaaagagccagactccggggcccctcatccgcctccgccccgcgtttcctccccccgatctcccaggggtcctcttttgagggcaccccagcccctcgacggtcc

SEQ ID NO: 12892 - DNA, 66 bp, Homo sapiens
  chr17:74072483-74072549
  hyper
tcctgctgccgggcccgccccatttccaggctccgctgagtgtctgggacacgctgggaggccccc

SEQ ID NO: 12893 - DNA, 38 bp, Homo sapiens; identical to SEQ ID NO: 1326
  chr17:74072998-74073036
  hyper

SEQ ID NO: 12894 - DNA, 136 bp, Homo sapiens
  chr17:74073246-74073382
  hyper
gcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacat

SEQ ID NO: 12895 - DNA, 63 bp, Homo sapiens
  chr17:74136379-74136442
  hyper
ggctgtcatccagggcgtcgggctcctccaggccgccctccggcccggcctcctccgccggcc

SEQ ID NO: 12896 - DNA, 130 bp, Homo sapiens
  chr17:74136570-74136700
  hyper
cgttacacggcctcccggacgcgcgcttccatctcgcgaccccgggggcgcctcctccgaataagtatgtggtgcctgcgaggaccacggtgggagctgagcactaccccacccccgaggggacagtgtg

SEQ ID NO: 12897 - DNA, 144 bp, Homo sapiens; identical to SEQ ID NO: 4498
  chr17:74534219-74534363
  hyper

SEQ ID NO: 12898 - DNA, 15 bp, Homo sapiens
  chr17:74534387-74534402
  hyper
cgcccaggctctggg

SEQ ID NO: 12899 - DNA, 85 bp, Homo sapiens
  chr17:74581216-74581301
  hyper
gggcttatccagacacggcgagcggaagccggggagaagggagcgggcgcggggcggacagagaccgcagcgggcgggaaaggcg

SEQ ID NO: 12900 - DNA, 293 bp, Homo sapiens
  chr17:74864739-74865032
  hyper
tgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtg

SEQ ID NO: 12901 - DNA, 567 bp, Homo sapiens; identical to SEQ ID NO: 4500
  chr17:74865591-74866158
  hyper

SEQ ID NO: 12902 - DNA, 128 bp, Homo sapiens
  chr17:75368774-75368902
  hyper
cccaggagggtgcagcggtggcccccggggcggtggtcgtggtgggggtgttagctgcaggggtgccctcggtgggtgggagttggtggcctctcgctggtgccatgggactcgcatgttcgccctgc

SEQ ID NO: 12903 - DNA, 188 bp, Homo sapiens
  chr17:75368903-75369091
  hyper
cccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgccc

SEQ ID NO: 12904 - DNA, 32 bp, Homo sapiens
  chr17:75369092-75369124
  hyper
ccctcctcgccatggcccggcctccacatccg

SEQ ID NO: 12905 - DNA, 18 bp, Homo sapiens
  chr17:75369440-75369458
  hyper
gcctaggggctcctccgg

SEQ ID NO: 12906 - DNA, 228 bp, Homo sapiens; identical to SEQ ID NO: 1328
  chr17:75369492-75369720
  hyper

SEQ ID NO: 12907 - DNA, 35 bp, Homo sapiens
  chr17:75370281-75370316
  hyper
tccgcctcccagaatcgggccgtgggggacagaag

SEQ ID NO: 12908 - DNA, 51 bp, Homo sapiens
  chr17:75524953-75525004
  hyper
atgcatcttctggaacggcagctgaggcaatgcggggtgtgaagtggcggc

SEQ ID NO: 12909 - DNA, 87 bp, Homo sapiens
  chr17:75525005-75525092
  hyper
ggcagaggggctcgcaggggctgggatccgcgtgcccctctctgcctcggtgcggagcacgatgtgcccgggcgggggcgaggacgt

SEQ ID NO: 12910 - DNA, 389 bp, Homo sapiens; identical to SEQ ID NO: 4503
  chr17:76227773-76228162
  hyper

SEQ ID NO: 12911 - DNA, 130 bp, Homo sapiens; identical to SEQ ID NO: 4504
  chr17:76228213-76228343
  hyper

SEQ ID NO: 12912 - DNA, 18 bp, Homo sapiens
  chr17:76254836-76254854
  hyper
cgccggggaggctgctgc

SEQ ID NO: 12913 - DNA, 102 bp, Homo sapiens; identical to SEQ ID NO: 4505
  chr17:77178962-77179064
  hyper

SEQ ID NO: 12914 - DNA, 249 bp, Homo sapiens; identical to SEQ ID NO: 4506
  chr17:77179081-77179330
  hyper

SEQ ID NO: 12915 - DNA, 75 bp, Homo sapiens; identical to SEQ ID NO: 4507
  chr17:77179380-77179455
  hyper

SEQ ID NO: 12916 - DNA, 27 bp, Homo sapiens
  chr17:77179456-77179483
  hyper
gcaggggggcgcccggcggcggctctg

SEQ ID NO: 12917 - DNA, 92 bp, Homo sapiens; identical to SEQ ID NO: 4509
  chr17:77179617-77179709
  hyper

SEQ ID NO: 12918 - DNA, 25 bp, Homo sapiens
  chr17:77179710-77179735
  hyper
ggcgagcgggcgagagcaggagtca

SEQ ID NO: 12919 - DNA, 265 bp, Homo sapiens
  chr17:77179951-77180216
  hyper
cctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgc

SEQ ID NO: 12920 - DNA, 36 bp, Homo sapiens
  chr17:77772754-77772790
  hyper
gaacgaacagcgcgtcgaggacgctcagatctccca

SEQ ID NO: 12921 - DNA, 295 bp, Homo sapiens
  chr17:77776679-77776974
  hyper
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggc

SEQ ID NO: 12922 - DNA, 42 bp, Homo sapiens
  chr17:77777233-77777275
  hyper
gccacggttgatgagcgcccctcctcccgtgacccagctcat

SEQ ID NO: 12923 - DNA, 64 bp, Homo sapiens; identical to SEQ ID NO: 4511
  chr17:77777585-77777649
  hyper

SEQ ID NO: 12924 - DNA, 254 bp, Homo sapiens; identical to SEQ ID NO: 4512
  chr17:77777650-77777904
  hyper

SEQ ID NO: 12925 - DNA, 18 bp, Homo sapiens
  chr17:77777943-77777961
  hyper
cgacgcctttcctcgcag

SEQ ID NO: 12926 - DNA, 30 bp, Homo sapiens
  chr17:77778966-77778996
  hyper
ccagggactcagttccgcaccctttgaaca

SEQ ID NO: 12927 - DNA, 804 bp, Homo sapiens
  chr17:78450039-78450843
  hyper
cttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgccca

SEQ ID NO: 12928 - DNA, 95 bp, Homo sapiens
  chr17:78451477-78451572
  hyper
gcggggctcggctcccgagatcgcggtccgggttccggcgccgggctgggggctcaggaccagggctggcgcagccgccccgccccgccccgccc

SEQ ID NO: 12929 - DNA, 59 bp, Homo sapiens
  chr17:78451801-78451860
  hyper
ccgggatcgggcgtccgcccctcgggcgggagcagaggccggctcgatggagacctttt

SEQ ID NO: 12930 - DNA, 232 bp, Homo sapiens
  chr17:78452108-78452340
  hyper
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggagg

SEQ ID NO: 12931 - DNA, 244 bp, Homo sapiens
  chr17:78452681-78452925
  hyper
aggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggtta

SEQ ID NO: 12932 - DNA, 39 bp, Homo sapiens
  chr17:79316974-79317013
  hyper
cgaagaggggacttgcgcggacggcgaggaggatcgatg

SEQ ID NO: 12933 - DNA, 121 bp, Homo sapiens
  chr17:79761692-79761813
  hyper
ggagctgggacccaccgcgaccaccacctgctgggccagggtccgcgggctcaggggtctgcaggattagggtctgcggaaccaggacccgtgggacaaaggtctgtggggcgcgggtccg

SEQ ID NO: 12934 - DNA, 329 bp, Homo sapiens
  chr17:79761833-79762162
  hyper
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggg

SEQ ID NO: 12935 - DNA, 75 bp, Homo sapiens
  chr17:79860521-79860596
  hyper
aaacctgcagaggtgcgagcggctccccgacggccgcgggacctaccagtgcaaggcgaacgtcttcctgtccct

SEQ ID NO: 12936 - DNA, 30 bp, Homo sapiens
  chr17:80329291-80329321
  hyper
ccacctgcgcgcgggcgggtccagggcttg

SEQ ID NO: 12937 - DNA, 263 bp, Homo sapiens; identical to SEQ ID NO: 4514
  chr17:80329738-80330001
  hyper

SEQ ID NO: 12938 - DNA, 78 bp, Homo sapiens
  chr17:80333151-80333229
  hyper
ctcaccaggaactaccgcgaccacctgcgcggccgcgtgcggggcccgggcagcgggggaggccgggggcccgttccc

SEQ ID NO: 12939 - DNA, 56 bp, Homo sapiens
  chr18:500061-500117
  hyper
cgccagcgcggggaccgctcgggccgggaaacggctagaggcgggaggagagagga

SEQ ID NO: 12940 - DNA, 890 bp, Homo sapiens; identical to SEQ ID NO: 4515
  chr18:500373-501263
  hyper

SEQ ID NO: 12941 - DNA, 30 bp, Homo sapiens
  chr18:903814-903844
  hyper
ccgcaggccgcgctccggaggcagcatgag

SEQ ID NO: 12942 - DNA, 113 bp, Homo sapiens
  chr18:904563-904676
  hyper
agcttcagaggcagccggagagacctcggagcagagaaggcgccgccgaccctcgcggctgcctggcccgcggctcctacaaaggcgggctagccgcccgccctctcccttgc

SEQ ID NO: 12943 - DNA, 55 bp, Homo sapiens
  chr18:905713-905768
  hyper
ggcagctcagggtcccgggtagagccagtgagcttctggccgctggagaaccccc

SEQ ID NO: 12944 - DNA, 232 bp, Homo sapiens
  chr18:906208-906440
  hyper
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacatta

SEQ ID NO: 12945 - DNA, 171 bp, Homo sapiens; identical to SEQ ID NO: 4516
  chr18:906736-906907
  hyper

SEQ ID NO: 12946 - DNA, 305 bp, Homo sapiens
  chr18:907314-907619
  hyper
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaa

SEQ ID NO: 12947 - DNA, 34 bp, Homo sapiens
  chr18:907943-907977
  hyper
acagaaaatcagcagcgggcgggtctgtgtggac

SEQ ID NO: 12948 - DNA, 87 bp, Homo sapiens
  chr18:908432-908519
  hyper
gcggcggtgggtgcccgtgggggccagggtgagtctgcgcccctgggtctggggtgggcatccgccacgggtcgcagttggagattt

SEQ ID NO: 12949 - DNA, 106 bp, Homo sapiens
  chr18:909183-909289
  hyper
cgtcgcctgcccggatcttatcccgggccccctccgcagggtttggtgccaggagatcctgcgtggggaggggggcatcgaggggctgccgtctcggccctcccca

SEQ ID NO: 12950 - DNA, 414 bp, Homo sapiens
  chr18:909318-909732
  hyper
cggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 12951 - DNA, 30 bp, Homo sapiens
  chr18:961954-961984
  hyper
tttcttccttcagggcgctagggacaccac

SEQ ID NO: 12952 - DNA, 134 bp, Homo sapiens
  chr18:2847537-2847671
  hyper
cgggcgatccgaaaacgactcccaggaattccatgagcccctgggaccatgggtgcttttctttcccgtcttggtcgggtccaggcgcgcgctctccagaggcgcacccgggcaccctccggcgtctgctcggt

SEQ ID NO: 12953 - DNA, 60 bp, Homo sapiens
  chr18:2848078-2848138
  hyper
gcggggcaccggccacgctgggctatttagggagtgggtgctgcccgagtgagtggggag

SEQ ID NO: 12954 - DNA, 270 bp, Homo sapiens; identical to SEQ ID NO: 4517
  chr18:3499101-3499371
  hyper

SEQ ID NO: 12955 - DNA, 15 bp, Homo sapiens
  chr18:5196244-5196259
  hyper
gtcggacgttcacaa

SEQ ID NO: 12956 - DNA, 68 bp, Homo sapiens; identical to SEQ ID NO: 4518
  chr18:5196575-5196643
  hyper

SEQ ID NO: 12957 - DNA, 90 bp, Homo sapiens
  chr18:5196858-5196948
  hyper
gactggggagaggggcgaaggcgacgcgccgaggcactcctccgccccatgagcacagacagtaactccgaaacgcgcagatgggccgta

SEQ ID NO: 12958 - DNA, 70 bp, Homo sapiens
  chr18:5197202-5197272
  hyper
gctagatcctggggccgcagctccagccgccgccgcgcgctctgcctccacaatgcggccacagcggcgg

SEQ ID NO: 12959 - DNA, 430 bp, Homo sapiens
  chr18:5197329-5197759
  hyper
cgacgtacactgctgcttagggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 12960 - DNA, 173 bp, Homo sapiens
  chr18:5542985-5543158
  hyper
tccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccc

SEQ ID NO: 12961 - DNA, 30 bp, Homo sapiens
  chr18:5544135-5544165
  hyper
gcctgccctcccagccgcgggggagggggc

SEQ ID NO: 12962 - DNA, 97 bp, Homo sapiens
  chr18:5628134-5628231
  hyper
gaggggcaagtcttgcggggcccgtcggtaactgccattatttgaatgcgatataggagatcccacatagaccctgctctaccgggttagaatctgt

SEQ ID NO: 12963 - DNA, 522 bp, Homo sapiens
  chr18:5628849-5629371
  hyper
cctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgc

SEQ ID NO: 12964 - DNA, 40 bp, Homo sapiens
  chr18:5629372-5629412
  hyper
cctctgcctcccggaggatcgcactcgctcatccttacac

SEQ ID NO: 12965 - DNA, 26 bp, Homo sapiens
  chr18:5629800-5629826
  hyper
agccagaccccaggtcgctccaactc

SEQ ID NO: 12966 - DNA, 371 bp, Homo sapiens
  chr18:5630262-5630633
  hyper
ctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagtt

SEQ ID NO: 12967 - DNA, 486 bp, Homo sapiens
  chr18:5895017-5895503
  hyper
cgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacaca

SEQ ID NO: 12968 - DNA, 30 bp, Homo sapiens
  chr18:5896006-5896036
  hyper
tactcctcggcacggcgcagcctgggctct

SEQ ID NO: 12969 - DNA, 41 bp, Homo sapiens
  chr18:6730009-6730050
  hyper
cgccttgtgcctgagcgcacgaccgccgtcactggatgttg

SEQ ID NO: 12970 - DNA, 115 bp, Homo sapiens
  chr18:7117059-7117174
  hyper
cgcctgcgggtccccctgcccgggacggctggctaggggcgcccttctcgccgcgtctctccccactagcccgcttggctgccaggggccccgaggaatccgccctttcccggcc

SEQ ID NO: 12971 - DNA, 7 bp, Homo sapiens
  chr18:7117615-7117622
  hyper
cgcctgc

SEQ ID NO: 12972 - DNA, 149 bp, Homo sapiens
  chr18:7117942-7118091
  hyper
ttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattc

SEQ ID NO: 12973 - DNA, 46 bp, Homo sapiens
  chr18:7118131-7118177
  hyper
cggccctgcagtccccgggccaggacccacgcgcccctgccaggag

SEQ ID NO: 12974 - DNA, 46 bp, Homo sapiens
  chr18:7566590-7566636
  hyper
gcccacacgggacaccgaggcatgatgaggacgcagaacagcagaa

SEQ ID NO: 12975 - DNA, 276 bp, Homo sapiens
  chr18:7567754-7568030
  hyper
ccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctg

SEQ ID NO: 12976 - DNA, 110 bp, Homo sapiens
  chr18:7568429-7568539
  hyper
cgcggctggcgaccccgggaggtccccgcggtcgtgcagcgtctgcggagaggctggggggagttcctcgccggtcccagcggtagggcttggcggccgcggagggaagc

SEQ ID NO: 12977 - DNA, 75 bp, Homo sapiens
  chr18:7568540-7568615
  hyper
ggcaggtccccaggccctggccacggccctgcgccccgctgggctccccctccccaccctcgtccccctagcgga

SEQ ID NO: 12978 - DNA, 44 bp, Homo sapiens
  chr18:8608938-8608982
  hyper
gcgttccagctacaccgagcgcgcgggggcgaaaacatgtgcat

SEQ ID NO: 12979 - DNA, 255 bp, Homo sapiens
  chr18:9709069-9709324
  hyper
caaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattc

SEQ ID NO: 12980 - DNA, 30 bp, Homo sapiens
  chr18:9771739-9771769
  hyper
gggtcagagaggattcgatggtggtgttct

SEQ ID NO: 12981 - DNA, 114 bp, Homo sapiens
  chr18:10455030-10455144
  hyper
ttcacggtgagttcccgagggccactcgagcgctcccagccggcggaggcagcccgggcgccgcggagcccgcggaggcgtcgggtctggatcgcggcacggcctacactgtcc

SEQ ID NO: 12982 - DNA, 334 bp, Homo sapiens
  chr18:11148760-11149094
  hyper
ctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctc

SEQ ID NO: 12983 - DNA, 128 bp, Homo sapiens
  chr18:11149115-11149243
  hyper
cgctctggcctcggccccggctctcggagctgcccggcgggctccgggtctcgccctccagcccccaggcggcccgcggcggatccccgagaggcagcgcagctcagcccctgcgccccccagcttcg

SEQ ID NO: 12984 - DNA, 199 bp, Homo sapiens; identical to SEQ ID NO: 4519
  chr18:11149561-11149760
  hyper

SEQ ID NO: 12985 - DNA, 52 bp, Homo sapiens; identical to SEQ ID NO: 4520
  chr18:11149779-11149831
  hyper

SEQ ID NO: 12986 - DNA, 63 bp, Homo sapiens
  chr18:11751569-11751632
  hyper
cgccaggagcagggacgcgtccgagccaacacggggcgcgcgcccagacgcactttcccggct

SEQ ID NO: 12987 - DNA, 252 bp, Homo sapiens; identical to SEQ ID NO: 4521
  chr18:11752127-11752379
  hyper

SEQ ID NO: 12988 - DNA, 6 bp, Homo sapiens
  chr18:11752599-11752605
  hyper
ggctcc

SEQ ID NO: 12989 - DNA, 90 bp, Homo sapiens; identical to SEQ ID NO: 4523
  chr18:11752640-11752730
  hyper

SEQ ID NO: 12990 - DNA, 123 bp, Homo sapiens
  chr18:11947268-11947391
  hyper
tagactcaggccagccgctgggcctgggcctgtgtgtccctcaggcggcgacctttggcccacttcaggccggccgtatttaccagcttagaggcgccgcggcgttggcgagtcctttttcac

SEQ ID NO: 12991 - DNA, 35 bp, Homo sapiens
  chr18:12253812-12253847
  hyper
ggcaggaagcccaggcgcctcggagaacctgaagg

SEQ ID NO: 12992 - DNA, 43 bp, Homo sapiens
  chr18:12254104-12254147
  hyper
tgaccaaaagagacccggggagcatctgggcttccaaggtcct

SEQ ID NO: 12993 - DNA, 148 bp, Homo sapiens; identical to SEQ ID NO: 4524
  chr18:12254432-12254580
  hyper

SEQ ID NO: 12994 - DNA, 324 bp, Homo sapiens; identical to SEQ ID NO: 1329
  chr18:12307602-12307926
  hyper

SEQ ID NO: 12995 - DNA, 350 bp, Homo sapiens; identical to SEQ ID NO: 1330
  chr18:13868570-13868920
  hyper

SEQ ID NO: 12996 - DNA, 76 bp, Homo sapiens
  chr18:13869161-13869237
  hyper
agaggaccagagccccgaggccagtcgcccccctcccgcccatccgcccgcccgcccgccacgcagggctgctcta

SEQ ID NO: 12997 - DNA, 25 bp, Homo sapiens
  chr18:15198059-15198084
  hyper
tagggggcgaaaagacgcaaaaagc

SEQ ID NO: 12998 - DNA, 24 bp, Homo sapiens
  chr18:15198144-15198168
  hyper
ccggggcggcgggggcaaaaagca

SEQ ID NO: 12999 - DNA, 57 bp, Homo sapiens
  chr18:18821835-18821892
  hyper
ccccctgtacacccccgcggggctgcgcgttcgtctgtgcggcggggtttgggaatg

SEQ ID NO: 13000 - DNA, 465 bp, Homo sapiens
  chr18:18822107-18822572
  hyper
agcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacct

SEQ ID NO: 13001 - DNA, 104 bp, Homo sapiens
  chr18:18822829-18822933
  hyper
gggcgacaggtagggcgccgcggaggtggcggggagaggatggatggagttcagcctgggaaagttgagaacgtccagaggtggctgggcgctcgctcggcgtc

SEQ ID NO: 13002 - DNA, 105 bp, Homo sapiens
  chr18:18823252-18823357
  hyper
cgcgactcgtttgcccggaactgccgctgcctctaaccgaggctgcgggtcctggagaaactcctcagtcttgcccctttctccggtgaacgtgacggttccaag

SEQ ID NO: 13003 - DNA, 51 bp, Homo sapiens
  chr18:22928965-22929016
  hyper
aatgctcagaagctgcgagtgaacaaaactgccaatcgtgcaaactttaat

SEQ ID NO: 13004 - DNA, 459 bp, Homo sapiens; identical to SEQ ID NO: 4527
  chr18:22929260-22929719
  hyper

SEQ ID NO: 13005 - DNA, 357 bp, Homo sapiens; identical to SEQ ID NO: 4528
  chr18:22929926-22930283
  hyper

SEQ ID NO: 13006 - DNA, 865 bp, Homo sapiens; identical to SEQ ID NO: 4529
  chr18:22930284-22931149
  hyper

SEQ ID NO: 13007 - DNA, 54 bp, Homo sapiens
  chr18:24128025-24128079
  hyper
cgtcggggtccagctcggagccgtccccgggcggcccaccgcgggcccggggcg

SEQ ID NO: 13008 - DNA, 138 bp, Homo sapiens
  chr18:24130809-24130947
  hyper
ccctttgtcctgggacgctcccaggttttcgggccgcggtgcggagaactcaggtgggtgcccggcaagttacctaccaggggctgttcccccgcgaccctcgccataagcgcagggacccgggggccgcgctggctc

SEQ ID NO: 13009 - DNA, 30 bp, Homo sapiens
  chr18:24131157-24131187
  hyper
acagctcccagttgacgtcaacttatttcc

SEQ ID NO: 13010 - DNA, 30 bp, Homo sapiens
  chr18:24764644-24764674
  hyper
acaccctggaggacccgacagactggcagc

SEQ ID NO: 13011 - DNA, 53 bp, Homo sapiens
  chr18:25755399-25755452
  hyper
caaagtgagagagcacgacccgggaggagagcgtggagccgggcagggacagg

SEQ ID NO: 13012 - DNA, 301 bp, Homo sapiens
  chr18:25756685-25756986
  hyper
cagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 13013 - DNA, 164 bp, Homo sapiens
  chr18:25757274-25757438
  hyper
aacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggc

SEQ ID NO: 13014 - DNA, 533 bp, Homo sapiens
  chr18:25757439-25757972
  hyper
ctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgc

SEQ ID NO: 13015 - DNA, 13 bp, Homo sapiens
  chr18:25758128-25758141
  hyper
cggggggtcgccg

SEQ ID NO: 13016 - DNA, 110 bp, Homo sapiens
  chr18:25758377-25758487
  hyper
acagcaaactaaggacgcaggccaagctcatcctagctattgttgtctgaggcgctcgccgggagccacctgcgggcgggggagggcggaggccgcggctcctctctgga

SEQ ID NO: 13017 - DNA, 125 bp, Homo sapiens; identical to SEQ ID NO: 4530
  chr18:28620831-28620956
  hyper

SEQ ID NO: 13018 - DNA, 135 bp, Homo sapiens; identical to SEQ ID NO: 4531
  chr18:28621033-28621168
  hyper

SEQ ID NO: 13019 - DNA, 279 bp, Homo sapiens; identical to SEQ ID NO: 4532
  chr18:28621709-28621988
  hyper

SEQ ID NO: 13020 - DNA, 242 bp, Homo sapiens
  chr18:28622475-28622717
  hyper
ctttgtccccagctccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttc

SEQ ID NO: 13021 - DNA, 30 bp, Homo sapiens
  chr18:30349740-30349770
  hyper
gggccgggatgagggcgaagcggaggcgct

SEQ ID NO: 13022 - DNA, 155 bp, Homo sapiens
  chr18:30350080-30350235
  hyper
cagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaag

SEQ ID NO: 13023 - DNA, 63 bp, Homo sapiens; identical to SEQ ID NO: 4533
  chr18:31020448-31020511
  hyper

SEQ ID NO: 13024 - DNA, 526 bp, Homo sapiens; identical to SEQ ID NO: 1331
  chr18:31739116-31739642
  hyper

SEQ ID NO: 13025 - DNA, 41 bp, Homo sapiens
  chr18:31802052-31802093
  hyper
tcttgtgaagaaaatcgacgctgctgcggctccccagcccc

SEQ ID NO: 13026 - DNA, 257 bp, Homo sapiens
  chr18:31802831-31803088
  hyper
aaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactc

SEQ ID NO: 13027 - DNA, 127 bp, Homo sapiens
  chr18:31803369-31803496
  hyper
gaggggaggagggtccggttgggcaccagcaatcaatgccccgtgctaccaagtctggtccattcgtaattgcaacggctgtctcggacgtttttcctgttcccttagcggtcggtctctttaatat

SEQ ID NO: 13028 - DNA, 76 bp, Homo sapiens
  chr18:32073450-32073526
  hyper
agtgactgaagcgcccgtccattccaaggtgtgtgcacggcgttttcttctttgacagctccggagtgggggaggg

SEQ ID NO: 13029 - DNA, 79 bp, Homo sapiens
  chr18:32073746-32073825
  hyper
agtcaagagtggaagcgggcggagagcgccggcgggggcagggattcgcctcaacgcccactcacggggttcccacctg

SEQ ID NO: 13030 - DNA, 205 bp, Homo sapiens
  chr18:34834309-34834514
  hyper
gagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgcc

SEQ ID NO: 13031 - DNA, 122 bp, Homo sapiens; identical to SEQ ID NO: 4535
  chr18:35065024-35065146
  hyper

SEQ ID NO: 13032 - DNA, 135 bp, Homo sapiens; identical to SEQ ID NO: 4536
  chr18:35065516-35065651
  hyper

SEQ ID NO: 13033 - DNA, 44 bp, Homo sapiens
  chr18:35104934-35104978
  hyper
cgccctcggccctccctttcttctctctccgcctgccctcctcc

SEQ ID NO: 13034 - DNA, 117 bp, Homo sapiens
  chr18:35144820-35144937
  hyper
tctctcccttttagacggctgcgctcctgctactctagcccggagcaaaggatgaggagaccacctcctttagtattttcagcaccacggcgatggacagcaccctcggtcctcggc

SEQ ID NO: 13035 - DNA, 334 bp, Homo sapiens
  chr18:35144968-35145302
  hyper
cgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggag

SEQ ID NO: 13036 - DNA, 40 bp, Homo sapiens
  chr18:35145558-35145598
  hyper
cgttgtcagcctgtccgtttgctaacgtggccatctttat

SEQ ID NO: 13037 - DNA, 75 bp, Homo sapiens
  chr18:35146102-35146177
  hyper
acggcgggcggcggccgggggcagggcggcgtggggcggcggccaccgcgcctcccccgtcggcggccccgcgcc

SEQ ID NO: 13038 - DNA, 55 bp, Homo sapiens
  chr18:35146710-35146765
  hyper
tttttttttcctcctcgcacccccaacctgccagagcagccccacatcttcctcc

SEQ ID NO: 13039 - DNA, 9 bp, Homo sapiens
  chr18:35146895-35146904
  hyper
cggaaggtg

SEQ ID NO: 13040 - DNA, 30 bp, Homo sapiens
  chr18:35147131-35147161
  hyper
ataaagcccctgaatcgctatctgggttgc

SEQ ID NO: 13041 - DNA, 53 bp, Homo sapiens
  chr18:43913567-43913620
  hyper
gcgccagcctccgagcgcacgtccccgagtgacccgtgcgcggtgtgcaggga

SEQ ID NO: 13042 - DNA, 228 bp, Homo sapiens
  chr18:43914398-43914626
  hyper
cgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 13043 - DNA, 262 bp, Homo sapiens; identical to SEQ ID NO: 1332
  chr18:44336188-44336450
  hyper

SEQ ID NO: 13044 - DNA, 164 bp, Homo sapiens; identical to SEQ ID NO: 1333
  chr18:44337012-44337176
  hyper

SEQ ID NO: 13045 - DNA, 202 bp, Homo sapiens; identical to SEQ ID NO: 1334
  chr18:44337416-44337618
  hyper

SEQ ID NO: 13046 - DNA, 193 bp, Homo sapiens; identical to SEQ ID NO: 1335
  chr18:44337649-44337842
  hyper

SEQ ID NO: 13047 - DNA, 140 bp, Homo sapiens; identical to SEQ ID NO: 1336
  chr18:44772977-44773117
  hyper

SEQ ID NO: 13048 - DNA, 501 bp, Homo sapiens; identical to SEQ ID NO: 1337
  chr18:44773466-44773967
  hyper

SEQ ID NO: 13049 - DNA, 59 bp, Homo sapiens
  chr18:44774406-44774465
  hyper
atgactgggtagctgcgcgggcctttggcccctgccccggcacccgcccccgcgcccgc

SEQ ID NO: 13050 - DNA, 94 bp, Homo sapiens
  chr18:44775481-44775575
  hyper
tgtcgggctggaaggcgctcgacggcgacgccagcaggatgtcgttgggccctggcagcggactggaagccatctccgccgcagaaccccgggc

SEQ ID NO: 13051 - DNA, 50 bp, Homo sapiens
  chr18:44777700-44777750
  hyper
cagcaagctgtgtgccggattggggcggccggttccggcaatacctggta

SEQ ID NO: 13052 - DNA, 277 bp, Homo sapiens; identical to SEQ ID NO: 4543
  chr18:44778049-44778326
  hyper

SEQ ID NO: 13053 - DNA, 51 bp, Homo sapiens
  chr18:44780673-44780724
  hyper
caatgctttcctcttcgagctgacatgcattttacacgtcaggactctcct

SEQ ID NO: 13054 - DNA, 38 bp, Homo sapiens
  chr18:44781003-44781041
  hyper
gttgaagagaacccacgctcagccgggcctgggcccag

SEQ ID NO: 13055 - DNA, 179 bp, Homo sapiens
  chr18:44786934-44787113
  hyper
tgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaa

SEQ ID NO: 13056 - DNA, 68 bp, Homo sapiens; identical to SEQ ID NO: 4544
  chr18:44787746-44787814
  hyper

SEQ ID NO: 13057 - DNA, 98 bp, Homo sapiens; identical to SEQ ID NO: 4545
  chr18:44789865-44789963
  hyper

SEQ ID NO: 13058 - DNA, 157 bp, Homo sapiens
  chr18:45058076-45058233
  hyper
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtc

SEQ ID NO: 13059 - DNA, 30 bp, Homo sapiens
  chr18:45663049-45663079
  hyper
gcaatggggcagtggcgagagttgctctct

SEQ ID NO: 13060 - DNA, 30 bp, Homo sapiens
  chr18:47088076-47088106
  hyper
cgcctccccagcggacgcagagtttcaggg

SEQ ID NO: 13061 - DNA, 42 bp, Homo sapiens
  chr18:47339612-47339654
  hyper
aaattgcaccgaaatcgctgtcgctagcgccttacaagtaag

SEQ ID NO: 13062 - DNA, 76 bp, Homo sapiens; identical to SEQ ID NO: 4546
  chr18:49867303-49867379
  hyper

SEQ ID NO: 13063 - DNA, 52 bp, Homo sapiens
  chr18:52989207-52989259
  hyper
aaatcctaatgcatacgcgagatcgattcaacttttccgaggggtttttatt

SEQ ID NO: 13064 - DNA, 139 bp, Homo sapiens; identical to SEQ ID NO: 4547
  chr18:52989807-52989946
  hyper

SEQ ID NO: 13065 - DNA, 30 bp, Homo sapiens
  chr18:53254709-53254739
  hyper
caacaggaggtagagcgagaaatgaatgga

SEQ ID NO: 13066 - DNA, 874 bp, Homo sapiens
  chr18:53255143-53256017
  hyper
gggagcgccgggcgccgggagcccgcggcgcgggaggcgcggagccgcgtgcggggccgccgagcccgaaccccgcgccgccgggcgcctccgccccgccgagccccgcaggcgccggtacctaccgcccgcgcgcgagaaggggctctccgtgcaccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaaggggggagggggaaacacgccgaggcgcacggaattgcaagttcagcaaagaaatgggtgggggggctccggcggggagacgcgacttgctccgggtcgggcaggctaggatgcatccccctcgcacccaccccgaggggaaaaaaaaaaaatctcaacacctcccccgcctcgccaaaaaatacaaacgaaaattcatcgagcacctcatttttcctcagatcgtcagttacaatctgaagcctgaacagttcagtttttgcccgttgcatccctcggaggcactttgaaatttattcgagtttacatcccctcacttctttctttctcttactctcgttccctctcactcacacatccacacacggcaaagcaagtttatactaggctgcaaatacacgtgatgcaaaaagactttgccaagaggaacaatatttttctttttcgtctataaatcaagccacattttcctggggagattttcgtttcggtagttttgcgttgggggcgaaatctgaattgc

SEQ ID NO: 13067 - DNA, 361 bp, Homo sapiens; identical to SEQ ID NO: 4548
  chr18:53256942-53257303
  hyper

SEQ ID NO: 13068 - DNA, 609 bp, Homo sapiens; identical to SEQ ID NO: 1338
  chr18:53446866-53447475
  hyper

SEQ ID NO: 13069 - DNA, 57 bp, Homo sapiens; identical to SEQ ID NO: 1339
  chr18:53447798-53447855
  hyper

SEQ ID NO: 13070 - DNA, 30 bp, Homo sapiens
  chr18:54789055-54789085
  hyper
agcgtggcctgagcccggtcagcggccggg

SEQ ID NO: 13071 - DNA, 102 bp, Homo sapiens; identical to SEQ ID NO: 4551
  chr18:55020597-55020699
  hyper

SEQ ID NO: 13072 - DNA, 141 bp, Homo sapiens; identical to SEQ ID NO: 4552
  chr18:55020804-55020945
  hyper

SEQ ID NO: 13073 - DNA, 277 bp, Homo sapiens; identical to SEQ ID NO: 4553
  chr18:55020965-55021242
  hyper

SEQ ID NO: 13074 - DNA, 32 bp, Homo sapiens
  chr18:55105140-55105172
  hyper
cgggcgctgattgtgcgcgcctggcgaccgcg

SEQ ID NO: 13075 - DNA, 102 bp, Homo sapiens
  chr18:55105728-55105830
  hyper
cttgtggggtgcactcgaccaacgcccgacagggctggggaatgtgacaggcagcaggttcacccgggcttggggagggggagtttccgctttgacagcatt

SEQ ID NO: 13076 - DNA, 30 bp, Homo sapiens
  chr18:55106031-55106061
  hyper
gatttgctgttggttcggggcaagataaag

SEQ ID NO: 13077 - DNA, 260 bp, Homo sapiens
  chr18:56887076-56887336
  hyper
agctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagcccc

SEQ ID NO: 13078 - DNA, 46 bp, Homo sapiens
  chr18:56887753-56887799
  hyper
ttgtgacctttctatcggcaaacaccttccccgttctcctaaaact

SEQ ID NO: 13079 - DNA, 30 bp, Homo sapiens
  chr18:56888148-56888178
  hyper
agggtgcagcgctcccgccccgggtttcac

SEQ ID NO: 13080 - DNA, 133 bp, Homo sapiens; identical to SEQ ID NO: 4554
  chr18:56888490-56888623
  hyper

SEQ ID NO: 13081 - DNA, 92 bp, Homo sapiens
  chr18:56931541-56931633
  hyper
atcaaatgctgaagccgccaaggctctcgggtccgcacccagggtgccctcaccgtacgccgaccgtgtggggaacacgctctctggaagct

SEQ ID NO: 13082 - DNA, 30 bp, Homo sapiens
  chr18:56933063-56933093
  hyper
gtgcttggagcagcacggtgccttttcttc

SEQ ID NO: 13083 - DNA, 363 bp, Homo sapiens; identical to SEQ ID NO: 4555
  chr18:56934956-56935319
  hyper

SEQ ID NO: 13084 - DNA, 317 bp, Homo sapiens
  chr18:56936333-56936650
  hyper
gcgggaacttgtccccgaagccgggcccgcacgggtaggagggcggcggcggcgcgagaggttgcaggccggggcccaacggcggggagttcaggaagggcggaggcggcggcggtggcgtgtagctggcaggcaggctctgcgccggcggcccgaagcccggcaggctctgcagcgccgtggcgcccccgcccggcagcggcggcccgagccaggactccagcggcagcgcgcccccagccggcccgccaccgctgcccgggcccgccccgaggggcgacagcgtcgcggagggcggggagcggctgaaggagagg

SEQ ID NO: 13085 - DNA, 154 bp, Homo sapiens; identical to SEQ ID NO: 1340
  chr18:56939498-56939652
  hyper

SEQ ID NO: 13086 - DNA, 408 bp, Homo sapiens; identical to SEQ ID NO: 1341
  chr18:56939763-56940171
  hyper

SEQ ID NO: 13087 - DNA, 680 bp, Homo sapiens; identical to SEQ ID NO: 1342
  chr18:56940565-56941245
  hyper

SEQ ID NO: 13088 - DNA, 240 bp, Homo sapiens; identical to SEQ ID NO: 1343
  chr18:56941557-56941797
  hyper

SEQ ID NO: 13089 - DNA, 37 bp, Homo sapiens
  chr18:57363706-57363743
  hyper
caaagattcgcaccgcgcggcacgcacccagcaggtt

SEQ ID NO: 13090 - DNA, 479 bp, Homo sapiens
  chr18:57364448-57364927
  hyper
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctc

SEQ ID NO: 13091 - DNA, 515 bp, Homo sapiens; identical to SEQ ID NO: 4560
  chr18:59000829-59001344
  hyper

SEQ ID NO: 13092 - DNA, 208 bp, Homo sapiens; identical to SEQ ID NO: 4561
  chr18:59001497-59001705
  hyper

SEQ ID NO: 13093 - DNA, 235 bp, Homo sapiens; identical to SEQ ID NO: 4562
  chr18:60263660-60263895
  hyper

SEQ ID NO: 13094 - DNA, 140 bp, Homo sapiens
  chr18:60985592-60985732
  hyper
cgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggc

SEQ ID NO: 13095 - DNA, 155 bp, Homo sapiens; identical to SEQ ID NO: 4563
  chr18:67067500-67067655
  hyper

SEQ ID NO: 13096 - DNA, 30 bp, Homo sapiens
  chr18:67067914-67067944
  hyper
gagccgggtggggagcgggcctcggggcgc

SEQ ID NO: 13097 - DNA, 48 bp, Homo sapiens
  chr18:67068735-67068783
  hyper
tggggactccaggagcgcctgagtccccatcctcgagtgcaccgggct

SEQ ID NO: 13098 - DNA, 238 bp, Homo sapiens
  chr18:70209148-70209386
  hyper
ctagggaggaggtgacggcgccgtccgccgacgggctggagtcgcacaccaccaggcacttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccggg

SEQ ID NO: 13099 - DNA, 72 bp, Homo sapiens
  chr18:70209493-70209565
  hyper
gggggccttcgtccccggctctgacgttcaaggccagggtcgttctcagaagaaaggcgcctgtgaacctgt

SEQ ID NO: 13100 - DNA, 30 bp, Homo sapiens
  chr18:70209822-70209852
  hyper
cgctaagacgggccccgagaccctcagaag

SEQ ID NO: 13101 - DNA, 50 bp, Homo sapiens
  chr18:70211036-70211086
  hyper
cccctcgagctcccgcgctcagcgcgtccgcagcgcggctccctcgcggg

SEQ ID NO: 13102 - DNA, 34 bp, Homo sapiens
  chr18:70534282-70534316
  hyper
gcaggttttgggatccggcgacggctgaccgcgc

SEQ ID NO: 13103 - DNA, 182 bp, Homo sapiens; identical to SEQ ID NO: 1344
  chr18:70535373-70535555
  hyper

SEQ ID NO: 13104 - DNA, 80 bp, Homo sapiens; identical to SEQ ID NO: 1345
  chr18:70535575-70535655
  hyper

SEQ ID NO: 13105 - DNA, 113 bp, Homo sapiens
  chr18:70535971-70536084
  hyper
accccaaggcacacacggacccccgttcccccgcgccacttcctcctacaggctcgcgcggcgcgttaaagtctgggagacacgagttgcggggaaacagcaccggaagagcc

SEQ ID NO: 13106 - DNA, 838 bp, Homo sapiens
  chr18:70536187-70537025
  hyper
cgccgcaacggcacctcctccctttcccggctccgtcccgccctccctcggcctctgcggacgcgacccacgcagaccacagccgagcccgccggaccccgggactacggaagccatcccgtccggccacccacacccgcgccgcggctggggcttgggttggggactgtggcggcgaagaagccggggtaggaagagctaatggcaatggcggggtcgccggggggcggggggtcagcagcagacgctgagctgtgaagactagggtggccccgaaaggccgaggaaaggagaaagggccatgagaagagtctggcgagcgctcgaggccggggggctgcctcccggctctggcccggcctccgcttcccggcacctgctgctggggcgcccacgtgcgcgcggggctgcgcggggcgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgtgtgcgcgcgcatatacgcgcgcgcgtgttgtgcatccgtgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 13107 - DNA, 33 bp, Homo sapiens
  chr18:70537332-70537365
  hyper
gtggtgggcaatgttcgtcgtggagttgaggaa

SEQ ID NO: 13108 - DNA, 349 bp, Homo sapiens
  chr18:72123440-72123789
  hyper
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagc

SEQ ID NO: 13109 - DNA, 48 bp, Homo sapiens
  chr18:72124237-72124285
  hyper
cgggtgtgatcccccctccccggacgcgcggcgcggggcagagcggcg

SEQ ID NO: 13110 - DNA, 32 bp, Homo sapiens
  chr18:73167800-73167832
  hyper
gcgcgcagcgggggccgcgtgatggatgggcc

SEQ ID NO: 13111 - DNA, 30 bp, Homo sapiens
  chr18:73628019-73628049
  hyper
aggccagttaggccgcgaagctttgccaaa

SEQ ID NO: 13112 - DNA, 47 bp, Homo sapiens
  chr18:73628494-73628541
  hyper
ggaggagcctgagggccaagagggccggcgcgcggtgggcgcggcct

SEQ ID NO: 13113 - DNA, 264 bp, Homo sapiens; identical to SEQ ID NO: 4566
  chr18:74961385-74961649
  hyper

SEQ ID NO: 13114 - DNA, 72 bp, Homo sapiens
  chr18:74961884-74961956
  hyper
gccctgtggacgactcggaatccctggaaaagccgggagggagtcggaggcgccagcccactggggaggtgg

SEQ ID NO: 13115 - DNA, 106 bp, Homo sapiens
  chr18:74962836-74962942
  hyper
ccactacttcttcaccgtgtccatgctggtgagcatcttcaccctggccgcgatgtccgtggaccgctacgtggccatcgtgcactcgcggcgctcctcctccctc

SEQ ID NO: 13116 - DNA, 143 bp, Homo sapiens
  chr18:75362885-75363028
  hyper
tgccggccatgccctcggctcctctcccgacacgcgccagcactgccccctgctggcctcccgggagcactgcccgctgccgcggcgggaggagacccgggaagaagccgggaccgcgagcagctggacgctttctccctggg

SEQ ID NO: 13117 - DNA, 245 bp, Homo sapiens
  chr18:75612186-75612431
  hyper
ctgcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 13118 - DNA, 235 bp, Homo sapiens
  chr18:77153209-77153444
  hyper
gtggcatctggcctgcggttcagtagggggaggaaagggtgggcgcacctgcccctggctggcgcacctgccaggtagccccacgcggcaccgcgtgtgccgagcgcccctgaggatggaaagccccacgcggggcaggtggcacccaccctccgaagacgggacgggatggagcgttgagcttcggggcagctccggcccggcccgcgctggagacgcccgcatctgccaggat

SEQ ID NO: 13119 - DNA, 119 bp, Homo sapiens
  chr18:77159847-77159966
  hyper
tagcgttggcggcctcgggctgggacctccccactcccggggctccgcagggcgcgcacgtggcgctcgggggtcaccgttgcagccgctttcccgaggaggcccggattgaaaacttc

SEQ ID NO: 13120 - DNA, 78 bp, Homo sapiens; identical to SEQ ID NO: 1346
  chr18:77547970-77548048
  hyper

SEQ ID NO: 13121 - DNA, 258 bp, Homo sapiens; identical to SEQ ID NO: 1347
  chr18:77548351-77548609
  hyper

SEQ ID NO: 13122 - DNA, 415 bp, Homo sapiens; identical to SEQ ID NO: 1348
  chr18:77557982-77558397
  hyper

SEQ ID NO: 13123 - DNA, 726 bp, Homo sapiens; identical to SEQ ID NO: 1349
  chr18:77558416-77559142
  hyper

SEQ ID NO: 13124 - DNA, 40 bp, Homo sapiens
  chr19:591461-591501
  hyper
gggcgtgcgcgtgtacgcccggggccggtgtgcaccggtg

SEQ ID NO: 13125 - DNA, 46 bp, Homo sapiens
  chr19:1401751-1401797
  hyper
ggggactggaatccccgccttgccgcttacgcgccatagattcctc

SEQ ID NO: 13126 - DNA, 245 bp, Homo sapiens
  chr19:1450187-1450432
  hyper
cccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactc

SEQ ID NO: 13127 - DNA, 34 bp, Homo sapiens
  chr19:1523753-1523787
  hyper
gcccccaaccccccacgcgcgagagagcctcagt

SEQ ID NO: 13128 - DNA, 72 bp, Homo sapiens; identical to SEQ ID NO: 4571
  chr19:1524442-1524514
  hyper

SEQ ID NO: 13129 - DNA, 30 bp, Homo sapiens
  chr19:1719137-1719167
  hyper
tgccccccacccacgcgaggctgcagcccc

SEQ ID NO: 13130 - DNA, 39 bp, Homo sapiens
  chr19:1725654-1725693
  hyper
ttcagtgcctggggccgcggcgatcgatgacagctgggc

SEQ ID NO: 13131 - DNA, 30 bp, Homo sapiens
  chr19:1750146-1750176
  hyper
cgcattcattgccatcgtttagtaaaacct

SEQ ID NO: 13132 - DNA, 113 bp, Homo sapiens
  chr19:1753693-1753806
  hyper
gcacagcgtggcccacgcgcaggcgggcgagctgctgagcccgggccacgcgcgctcggcggcggcgcagcaccgcggcctggtggcgcccgggcgcccgggcctggtggccg

SEQ ID NO: 13133 - DNA, 562 bp, Homo sapiens
  chr19:1754313-1754875
  hyper
cgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggc

SEQ ID NO: 13134 - DNA, 250 bp, Homo sapiens
  chr19:1757376-1757626
  hyper
gtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtc

SEQ ID NO: 13135 - DNA, 74 bp, Homo sapiens
  chr19:1757980-1758054
  hyper
ccaaggagaactttgcgccccgggtctcccgtcgcgcttgcccggctcggggcgggccacgcgtttccgcaggt

SEQ ID NO: 13136 - DNA, 66 bp, Homo sapiens
  chr19:1762172-1762238
  hyper
ccatctggagaccctcgtgctggctgctgggggtcctgcgtgccttccgcgcgcccccagctgcgc

SEQ ID NO: 13137 - DNA, 32 bp, Homo sapiens
  chr19:1762474-1762506
  hyper
ccatcacccagcaaacgccgtcccgcagcacc

SEQ ID NO: 13138 - DNA, 169 bp, Homo sapiens
  chr19:1762627-1762796
  hyper
ggcgccaggagacccgggacccgggaccacgcgcccgcggccttggagcctcagggtcactggtgcgggctccgcaggaaagcgcagcccccagcaggcacccaccatcccacccccgcatcccaccccaggggaaaccgcgccgcaccaggcgcgagtgttcttcttc

SEQ ID NO: 13139 - DNA, 30 bp, Homo sapiens
  chr19:1765699-1765729
  hyper
ggctctgggtcactgcgtccacttgataaa

SEQ ID NO: 13140 - DNA, 39 bp, Homo sapiens
  chr19:1769737-1769776
  hyper
cgcggtaaacagctccgactggatcgatctgggctgtga

SEQ ID NO: 13141 - DNA, 254 bp, Homo sapiens
  chr19:1776259-1776513
  hyper
acctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttc

SEQ ID NO: 13142 - DNA, 345 bp, Homo sapiens
  chr19:1856999-1857344
  hyper
ctgccgcacgtagctcggcggcggcggcggggacatccgcagccccagccggccccgctcacgtggtcccactcccgccggggccagggggcccgggccagggtcgcctctccggcctgggtgcctgccagccccgccccgcgcttggagactgaggcgcgcacatgcgcacgtgggtggcggggcagggggtgcacgggctacccacccacgctgcgctgggcgaagcgcctctgcgaaatgccaggccctgcctcgcacacaatccactcgcagggaggagggtggggtgaacttgtgggggcccagagcgcgctgctcctagccagccgggcccccaggtgc

SEQ ID NO: 13143 - DNA, 83 bp, Homo sapiens
  chr19:2251152-2251235
  hyper
ctcacgcgcctggtgcgggcgctgcgggtccccccggcccgggcctccgcgccgcgcctggccctggatccggacgcgctggc

SEQ ID NO: 13144 - DNA, 105 bp, Homo sapiens
  chr19:2251610-2251715
  hyper
gggtcgggcacagcgcagcgcgggggccaccgccgccgacgggccgtgcgcgctgcgcgagctcagcgtagacctccgcgccgagcgctccgtactcatccccga

SEQ ID NO: 13145 - DNA, 856 bp, Homo sapiens; identical to SEQ ID NO: 4572
  chr19:2252588-2253444
  hyper

SEQ ID NO: 13146 - DNA, 266 bp, Homo sapiens; identical to SEQ ID NO: 4573
  chr19:2290006-2290272
  hyper

SEQ ID NO: 13147 - DNA, 238 bp, Homo sapiens; identical to SEQ ID NO: 4574
  chr19:2290630-2290868
  hyper

SEQ ID NO: 13148 - DNA, 179 bp, Homo sapiens
  chr19:2302772-2302951
  hyper
gcaggggggccgggccggcggcagggacggcgttggcggtggtggacgggagtgggggtctgtcctgaacaggtgggggtggtccctgtgctggcccccgccatgcgatcgcaccccaggactctcctcctcttcctaagccccagcatgtgcctggtgccgcgcgggtgctggaggca

SEQ ID NO: 13149 - DNA, 15 bp, Homo sapiens
  chr19:3585992-3586007
  hyper
ggggccccctttgca

SEQ ID NO: 13150 - DNA, 199 bp, Homo sapiens; identical to SEQ ID NO: 1350
  chr19:3785637-3785836
  hyper

SEQ ID NO: 13151 - DNA, 357 bp, Homo sapiens; identical to SEQ ID NO: 1351
  chr19:3785864-3786221
  hyper

SEQ ID NO: 13152 - DNA, 16 bp, Homo sapiens
  chr19:3786583-3786599
  hyper
gcgcggcggggaccgg

SEQ ID NO: 13153 - DNA, 48 bp, Homo sapiens
  chr19:3822204-3822252
  hyper
cacagaacagccgcacgcgcaccaggcacgaggcggggtgggatgtga

SEQ ID NO: 13154 - DNA, 48 bp, Homo sapiens
  chr19:3868851-3868899
  hyper
ggctgggactggggccgggccgggcgcacgcggcgggagaaggggtag

SEQ ID NO: 13155 - DNA, 226 bp, Homo sapiens
  chr19:3880562-3880788
  hyper
gccaatggggaggatcggattctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccac

SEQ ID NO: 13156 - DNA, 30 bp, Homo sapiens
  chr19:3881573-3881603
  hyper
ggccgtccccaaatgcgaagccaggatctg

SEQ ID NO: 13157 - DNA, 167 bp, Homo sapiens
  chr19:3933513-3933680
  hyper
aggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcat

SEQ ID NO: 13158 - DNA, 138 bp, Homo sapiens
  chr19:4198030-4198168
  hyper
ggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagc

SEQ ID NO: 13159 - DNA, 70 bp, Homo sapiens
  chr19:4304487-4304557
  hyper
tatcaccaccaacaccgcccagtgagccccaggcgctggatgtgagggctctgggcgaggccagcgcgga

SEQ ID NO: 13160 - DNA, 48 bp, Homo sapiens
  chr19:5292738-5292786
  hyper
tacctgccccctctgcggtcctgttgcctcctccgccttctgcgaagt

SEQ ID NO: 13161 - DNA, 71 bp, Homo sapiens
  chr19:5293067-5293138
  hyper
ggagcctggagggggcgcgacaagagagacaaagcccggggcggcccgggcctcggggtggaagggggtcc

SEQ ID NO: 13162 - DNA, 27 bp, Homo sapiens
  chr19:5293155-5293182
  hyper
cggctcggagatcgggcccaggccccg

SEQ ID NO: 13163 - DNA, 48 bp, Homo sapiens
  chr19:5294020-5294068
  hyper
tccaccggaggggcccggaatgtagaagcccagcgggacctgggggtc

SEQ ID NO: 13164 - DNA, 30 bp, Homo sapiens
  chr19:5338746-5338776
  hyper
tgcaaatggcagattcgaccaagtccctgg

SEQ ID NO: 13165 - DNA, 68 bp, Homo sapiens
  chr19:5339068-5339136
  hyper
tccctgctgctcagccgggactccgacacctcggacacccgcttcactagccgcggctgccgggatgt

SEQ ID NO: 13166 - DNA, 94 bp, Homo sapiens
  chr19:5340523-5340617
  hyper
cagccgagcatcctccgagcacaatggccgtgcaggcttccccggcacaaagccggcgcgctgcccactcggctgcctccgagaccccccttgg

SEQ ID NO: 13167 - DNA, 214 bp, Homo sapiens
  chr19:5437029-5437243
  hyper
gactcctgcccccagcgacgcccagttcctcccataggagcaaaaaggacaaaagactcccccatgcctccagtagtcaaagacccccgagctgcccatcccagacactcgcgcaggtatggagcgcctactgtatgccagccccgagactcattggggatgcagcggtggcgacatcagccccgggtccctgtccccacggggctcccaggat

SEQ ID NO: 13168 - DNA, 33 bp, Homo sapiens
  chr19:5567596-5567629
  hyper
ggcgcccgcctcccccgccgctctccaggggtc

SEQ ID NO: 13169 - DNA, 225 bp, Homo sapiens
  chr19:5828090-5828315
  hyper
gacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactga

SEQ ID NO: 13170 - DNA, 141 bp, Homo sapiens; identical to SEQ ID NO: 1353
  chr19:6590370-6590511
  hyper

SEQ ID NO: 13171 - DNA, 38 bp, Homo sapiens
  chr19:6590785-6590823
  hyper
ctcattctgtcttttcggtcacgcgcctctctatgttt

SEQ ID NO: 13172 - DNA, 335 bp, Homo sapiens
  chr19:7794909-7795244
  hyper
catccaggcccccaacgatcaccaggtgcgcgctggcatctgcgcagtgatcctgcgccgccgcccacgtcgtctttggcacagagaaaaagtagcaggagccctcgaaggacagccacgacgtggggcacggctcgcaggagtctgcggggtggcgagggtcagagaggtcgcgtgcttccaggggcaacgcaccgagaggatgcagtgggtaggggttcggccccgcgggctcaggggtggagacacagaaccaggccaaggtccaggagtgacagggtccgcttacgccctcacagcccgcccccgaccccccgtctcgctcactgttctgg

SEQ ID NO: 13173 - DNA, 127 bp, Homo sapiens
  chr19:7795565-7795692
  hyper
ggtcagcactcaggacggggtcggggtcgggggacgcggccagggctcagggccggggtcgcgtcgggccctcaccgcgctcacgcagttcccgcagggcgctctcctgctccatcagcttcgcctg

SEQ ID NO: 13174 - DNA, 9 bp, Homo sapiens
  chr19:7795734-7795743
  hyper
cgtccccga

SEQ ID NO: 13175 - DNA, 90 bp, Homo sapiens
  chr19:7852997-7853087
  hyper
ggccgtttgcagtcacgcgtgtgcacatggcgtgcacgtatgtgtgcgagtccccacgcgtttgtctcccatcggcgtgtgtgcacatag

SEQ ID NO: 13176 - DNA, 110 bp, Homo sapiens
  chr19:7853361-7853471
  hyper
ccctgagtctggccacggggtgtggaagggagtcccctgagtcctcccaagtgacccggcgggcatgcgttttgggatgggggtcgttccagcctcgaagcagacggcgg

SEQ ID NO: 13177 - DNA, 60 bp, Homo sapiens
  chr19:7853543-7853603
  hyper
cgcaagggtggggtcttgtggccgggatgggaggggggccggaggcgaggcctgcggcga

SEQ ID NO: 13178 - DNA, 42 bp, Homo sapiens
  chr19:7927482-7927524
  hyper
gccccgcccccaatccgcctctgccggcgtcctgcctcccga

SEQ ID NO: 13179 - DNA, 259 bp, Homo sapiens
  chr19:8115235-8115494
  hyper
aagtctgggtaacaccgtcttggccgcggcccgcgggttgggaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctct

SEQ ID NO: 13180 - DNA, 118 bp, Homo sapiens; identical to SEQ ID NO: 1354
  chr19:9473938-9474056
  hyper

SEQ ID NO: 13181 - DNA, 50 bp, Homo sapiens
  chr19:9517741-9517791
  hyper
attcacttccgtttccgggagcgcacttccgtttccaggcatgagggcaa

SEQ ID NO: 13182 - DNA, 105 bp, Homo sapiens
  chr19:9608931-9609036
  hyper
tttaaggcctcagaacgcttggacacttttgaagacgggaacacacggctgaaaacagccctcggacgcgcccatactgcacttcccacccggctcctctagggg

SEQ ID NO: 13183 - DNA, 40 bp, Homo sapiens; identical to SEQ ID NO: 4580
  chr19:9609379-9609419
  hyper

SEQ ID NO: 13184 - DNA, 359 bp, Homo sapiens
  chr19:9903669-9904028
  hyper
gtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatggagggagtctgttgggcgggacctcgaaatgcctctgctcgctttcctctgcattcatgcggcttgtacgaggatgcgctgtttcctggtggtttgttatacggcagtagataact

SEQ ID NO: 13185 - DNA, 295 bp, Homo sapiens
  chr19:10398157-10398452
  hyper
tcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgc

SEQ ID NO: 13186 - DNA, 30 bp, Homo sapiens
  chr19:10400448-10400478
  hyper
tcatgccggcctccacgtagaccccagggg

SEQ ID NO: 13187 - DNA, 7 bp, Homo sapiens
  chr19:10406153-10406160
  hyper
tcaacat

SEQ ID NO: 13188 - DNA, 133 bp, Homo sapiens; identical to SEQ ID NO: 4582
  chr19:10406278-10406411
  hyper

SEQ ID NO: 13189 - DNA, 95 bp, Homo sapiens
  chr19:10406935-10407030
  hyper
gtgcctgtgggagtgcggggggcggtgggagaagccccccggagcttggccaccctccgcgagggtctccaccccgcaggtccgtggctatgggt

SEQ ID NO: 13190 - DNA, 4 bp, Homo sapiens
  chr19:10407044-10407048
  hyper
cggc

SEQ ID NO: 13191 - DNA, 153 bp, Homo sapiens
  chr19:10531548-10531701
  hyper
cctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccc

SEQ ID NO: 13192 - DNA, 203 bp, Homo sapiens
  chr19:10616329-10616532
  hyper
atttgaaagattgaacgtcctggctcagggtctggaaggaatcacgtgtagggctacgttggagttaccccgctaccccaaatccttgttgcgtgtagatgcagttccagacagctcctcaggggggcggcctagatagtccgtgaacacgctgagtggccgaggttgtaaccagcgccttcctggcacgttgcagaaaacaa

SEQ ID NO: 13193 - DNA, 4 bp, Homo sapiens
  chr19:10624849-10624853
  hyper
gcgc

SEQ ID NO: 13194 - DNA, 443 bp, Homo sapiens; identical to SEQ ID NO: 1356
  chr19:10624965-10625408
  hyper

SEQ ID NO: 13195 - DNA, 30 bp, Homo sapiens
  chr19:10629493-10629523
  hyper
agggggcactcaggccgggtcaggccccca

SEQ ID NO: 13196 - DNA, 72 bp, Homo sapiens
  chr19:10691925-10691997
  hyper
tcccctaaatgcttacggccagtgagctcgaagagcacgcggtcattgaggcccagccgcagctctggcatt

SEQ ID NO: 13197 - DNA, 118 bp, Homo sapiens
  chr19:11529773-11529891
  hyper
cactgggtcaagggccgcgagtccccaggaggggactccagggcaagttcagattgggagcagataccgtccgacgggcgggcgcttggagtttctggacctgcgggtcaccagggat

SEQ ID NO: 13198 - DNA, 100 bp, Homo sapiens
  chr19:11531503-11531603
  hyper
taggacctccgagagcgacggtgcttcttgtgactttcgattaatttctgggaacggatcttgagtgatgcgcgggtcactacctcgttgtcctcctcct

SEQ ID NO: 13199 - DNA, 17 bp, Homo sapiens
  chr19:11532425-11532442
  hyper
cacgaggcccagcaggt

SEQ ID NO: 13200 - DNA, 154 bp, Homo sapiens; identical to SEQ ID NO: 4585
  chr19:11591031-11591185
  hyper

SEQ ID NO: 13201 - DNA, 585 bp, Homo sapiens; identical to SEQ ID NO: 4586
  chr19:11592710-11593295
  hyper

SEQ ID NO: 13202 - DNA, 121 bp, Homo sapiens
  chr19:11689402-11689523
  hyper
cctgcctgcctcctccgtgctgggcgccgccgcgacacgtcccgcggacattcaggagtcccttcagtccctgcgagcgcggacccgggagagagctctcattcaacgctgaggccactgg

SEQ ID NO: 13203 - DNA, 45 bp, Homo sapiens
  chr19:11909467-11909512
  hyper
tgacgctgtcacctgcgctgtgacctgctccggagtcataaagag

SEQ ID NO: 13204 - DNA, 30 bp, Homo sapiens
  chr19:11909854-11909884
  hyper
gggtcggatgtgtcccgcctttcttctgct

SEQ ID NO: 13205 - DNA, 30 bp, Homo sapiens
  chr19:11959427-11959457
  hyper
ctgtcagtctggctccgcagggcctgatac

SEQ ID NO: 13206 - DNA, 97 bp, Homo sapiens; identical to SEQ ID NO: 4587
  chr19:11959663-11959760
  hyper

SEQ ID NO: 13207 - DNA, 272 bp, Homo sapiens; identical to SEQ ID NO: 4588
  chr19:11959761-11960033
  hyper

SEQ ID NO: 13208 - DNA, 314 bp, Homo sapiens
  chr19:11998761-11999075
  hyper
gtgtagagaggaccccgggacatctgaaagccaggaaatggtgcgtgtctggggccgggtgtcgtgagacgggggaggggctgcctggaccgaccggaaccgactgtggcgagaccctggctttcctgcgggcgactttgggatctgggaccgagtcctcctggagccgctcggccctcggtcccctcgactgctcggtgtggctgggccggtagccgggacaccaggcgtcctgtctcgtctctgcgcggcgactgcggttccagagccctctatgggcagctccgcgcccgcagccacgcgtctacccagat

SEQ ID NO: 13209 - DNA, 62 bp, Homo sapiens
  chr19:12075756-12075818
  hyper
ctcagaagtgaggggcggggcctagcattccatccaatcagaggtgccggggcagggccctg

SEQ ID NO: 13210 - DNA, 117 bp, Homo sapiens
  chr19:12076262-12076379
  hyper
ctctctgggcagttccgcgcccgcagccccgcgtctccccagattatgcggaagccacgagagggtcatgggggaaatcctgactcgtgtgtagggttcgtgcgtgggaggagcagt

SEQ ID NO: 13211 - DNA, 160 bp, Homo sapiens
  chr19:12146813-12146973
  hyper
gctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacc

SEQ ID NO: 13212 - DNA, 16 bp, Homo sapiens
  chr19:12163328-12163344
  hyper
cacaatctggggagac

SEQ ID NO: 13213 - DNA, 458 bp, Homo sapiens
  chr19:12175474-12175932
  hyper
ccacccaatcagagtcgccggggtggggcccggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctggggcccgagccccgctggcgcagctcggccttcggtccattcggccgccgggtgcggctgggccggcagccgggacccctgggcgccctgtctcgtcgccgcgcggcgactgcggccccag

SEQ ID NO: 13214 - DNA, 336 bp, Homo sapiens; identical to SEQ ID NO: 1357
  chr19:12203013-12203349
  hyper

SEQ ID NO: 13215 - DNA, 343 bp, Homo sapiens; identical to SEQ ID NO: 1358
  chr19:12203350-12203693
  hyper

SEQ ID NO: 13216 - DNA, 289 bp, Homo sapiens; identical to SEQ ID NO: 4591
  chr19:12267019-12267308
  hyper

SEQ ID NO: 13217 - DNA, 342 bp, Homo sapiens; identical to SEQ ID NO: 4592
  chr19:12267309-12267651
  hyper

SEQ ID NO: 13218 - DNA, 15 bp, Homo sapiens
  chr19:12306229-12306244
  hyper
cgtgtctccccagat

SEQ ID NO: 13219 - DNA, 244 bp, Homo sapiens
  chr19:12750866-12751110
  hyper
tactccgctcacctgcgacggcagcagccagtccccacgggcggaggggacctcatgcgacattcagcccgcgagattctcagagactgctcgcccgcaacacgcagtaacgatctcaggagagcccatgatggggcggcgcgtgtcgtagccgagaagactctgtcatcgccggcgacctcctggaactctctcttgcggtttgcagccagatcacttcccatacacgcggcagccaagctca

SEQ ID NO: 13220 - DNA, 147 bp, Homo sapiens
  chr19:12936457-12936604
  hyper
gggtgtcctgaggggcggggctgggggaagggtcgctcccccaactcagggccacgcgtccgctaggggccgctgccgcttccactgccactcccgctgcccgcagcgtccaggatggaggtgcgagggctgcgggaacgccgggag

SEQ ID NO: 13221 - DNA, 36 bp, Homo sapiens
  chr19:12952093-12952129
  hyper
gtggggctccctttgcggcaggtcgaaagcgcgtgc

SEQ ID NO: 13222 - DNA, 9 bp, Homo sapiens
  chr19:12952130-12952139
  hyper
ccctgggcg

SEQ ID NO: 13223 - DNA, 261 bp, Homo sapiens; identical to SEQ ID NO: 1359
  chr19:13616696-13616957
  hyper

SEQ ID NO: 13224 - DNA, 307 bp, Homo sapiens; identical to SEQ ID NO: 1360
  chr19:13617158-13617465
  hyper

SEQ ID NO: 13225 - DNA, 29 bp, Homo sapiens
  chr19:13617489-13617518
  hyper
cggtttgcaaaggacgccccccccgggac

SEQ ID NO: 13226 - DNA, 30 bp, Homo sapiens
  chr19:13617846-13617876
  hyper
aaggagtcttcacaccgcagggtccaggtt

SEQ ID NO: 13227 - DNA, 107 bp, Homo sapiens
  chr19:13618303-13618410
  hyper
cgacacatgagggcccgcgaccaatcgtggaggctcgtggaggcgcgggggtaccgggctcagcggagtttgtgggggagagaggggagcgtcgcatggttgggagg

SEQ ID NO: 13228 - DNA, 340 bp, Homo sapiens
  chr19:14320312-14320652
  hyper
aggaggcaaagagtgcggaggggctggggggcgcgtaaagagccctggcgcccctcaggccttcggctgcgcagccgcagtggaggccgcgccagcaaccgggctccgggaaccaaggcgtccgcgcgcgcacgcagactcgcccgcgcgccgcgtgccccgcgctgcccaggtcggtacccgcgcttcggacaccctgctcccagggcgctcctcgcttccagcctcccactttgcgccttgggctccccatgagccccgctcctgagacaccccacgctctgtgtattccgtcccacgggacctccacgcccacggtgccacgcgcctcgagtacccc

SEQ ID NO: 13229 - DNA, 135 bp, Homo sapiens
  chr19:14583381-14583516
  hyper
ctgaggccgctgtgccgggagctgcgcagcgagctggcctcccaggcgctcggtgttaggcccagccccgcggggccgcccttggctccggccctcgggggcaagaggcgaagcagttggcgcagcacggcctgg

SEQ ID NO: 13230 - DNA, 107 bp, Homo sapiens
  chr19:14583613-14583720
  hyper
cgccgacggccagcgccaccaacacctgcgggggaagccggtgtgagctatagagcaggcgcgggcgcaggggggcgcagggatggtgggggcgtggctggaaggta

SEQ ID NO: 13231 - DNA, 173 bp, Homo sapiens; identical to SEQ ID NO: 4597
  chr19:14584240-14584413
  hyper

SEQ ID NO: 13232 - DNA, 26 bp, Homo sapiens
  chr19:14584536-14584562
  hyper
cgccagccgcccgggggacccaggcc

SEQ ID NO: 13233 - DNA, 15 bp, Homo sapiens
  chr19:14886822-14886837
  hyper
cgggcgcccctccca

SEQ ID NO: 13234 - DNA, 477 bp, Homo sapiens; identical to SEQ ID NO: 4599
  chr19:15090075-15090552
  hyper

SEQ ID NO: 13235 - DNA, 66 bp, Homo sapiens
  chr19:15090784-15090850
  hyper
ccccagcatccctggcggagcgcggggaacaggccctggcaccgcgggacccgctccagcagcctc

SEQ ID NO: 13236 - DNA, 33 bp, Homo sapiens
  chr19:15121861-15121894
  hyper
ggagatgatcaaaggcggcggcaccttggagaa

SEQ ID NO: 13237 - DNA, 370 bp, Homo sapiens
  chr19:15288513-15288883
  hyper
ctgggctgttgcactcgcggtcgcagcgctggtccccgcgcttggcctggcaggcggcgcgcgggcaccgcggctcctccgagacctcgggtgccgcggcgggcgcctcgcagcgcggcccggtccagccctgcgcgcaagcgcagcggaagaagggcgcgagcggcgcggggcggcaggagcccccgtggagacagggggcggccgcgcagctggcgttgctggcccccggcggcgaccccgggaagctgcggcaggagggtcccgacaaccctggggggcaggcgcagcgcggcccgcggggcgtctgctggcatgggacgcccaccgggcactgcagctcccggcaggagcgcgccacccgctcgca

SEQ ID NO: 13238 - DNA, 72 bp, Homo sapiens
  chr19:15333743-15333815
  hyper
ttcctcccagtctcacggaaatgctaaatcatcccggcgtgggaggcttctgtgggtcggggcgcagctttg

SEQ ID NO: 13239 - DNA, 34 bp, Homo sapiens
  chr19:15334731-15334765
  hyper
ctgggggtccctgctcggtcgggacagtgggacc

SEQ ID NO: 13240 - DNA, 693 bp, Homo sapiens
  chr19:15342587-15343280
  hyper
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcgaccccacgcgaccccgcagccccgatagcgcccccgtgcgatcaccttgaggttcaggaaaccgtgctcacccagcgaggggtcgctcaggcaggcgggggacgcgctccgacggcgcccgcagcagccgcgccggggccggcacagcacgtgcgtgagcgctatgcagccgtagaccgccgcggccaccagcgccaccgagaacaccaggctccacatgaaggcgcgcagcagcttcagcgacaggcgcgacggcgccagcagcgcggtcaccaccagctccggcatgtcgccgcgctccgggaccacggcggcgctgccggccaggggcacctgcagcagcggcgaagcggtgtcagggctcaggggcccatcgcccttggcctggggcccctccgtgccgtcgggatttgtgggacgcgctgaaggaagaggcgggcggctccgacagaaaacagccagagcgcaccactcacctgagtgccaggtaaacacctgggcgcgacagggacaggaaacaagggtagggtgcggaggctggggagg

SEQ ID NO: 13241 - DNA, 151 bp, Homo sapiens
  chr19:15343980-15344131
  hyper
caatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcc

SEQ ID NO: 13242 - DNA, 208 bp, Homo sapiens
  chr19:15619208-15619416
  hyper
ttttctagggggcagcgctggagtccccgcccagaaccctgcgggagcccggggcgggatgtccgggggcggacccctcggcacggccgggcggggttaaagggttgggccgtgggacggcgcggtcagatcccaggtagtggcgccggtggatccggatcgagggcaggaggctgagacccgcgggtgagtgcgcgcgtggtgaggg

SEQ ID NO: 13243 - DNA, 237 bp, Homo sapiens
  chr19:15695292-15695529
  hyper
cccagacgaggttcccggcgcgatggggccgggatgggggtcctgggcacagtcagagtccccaccccctcccccgggaactgcatcggccagacgttcgccatggctgagatgaaggtggtcctggcgctcacgctgctgcgcttccgcgtcctgccggaccacgcggagccccgcaggaagctggagctgatcgtgcgcgcggaggatggactttggctacgggtggagcccctg

SEQ ID NO: 13244 - DNA, 138 bp, Homo sapiens; identical to SEQ ID NO: 1362
  chr19:17007251-17007389
  hyper

SEQ ID NO: 13245 - DNA, 347 bp, Homo sapiens; identical to SEQ ID NO: 1363
  chr19:17007446-17007793
  hyper

SEQ ID NO: 13246 - DNA, 44 bp, Homo sapiens; identical to SEQ ID NO: 4602
  chr19:17008475-17008519
  hyper

SEQ ID NO: 13247 - DNA, 114 bp, Homo sapiens; identical to SEQ ID NO: 4603
  chr19:17008585-17008699
  hyper

SEQ ID NO: 13248 - DNA, 276 bp, Homo sapiens
  chr19:17137083-17137359
  hyper
cccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactca

SEQ ID NO: 13249 - DNA, 18 bp, Homo sapiens
  chr19:17137395-17137413
  hyper
cgccgacagcagcaggag

SEQ ID NO: 13250 - DNA, 169 bp, Homo sapiens
  chr19:17392904-17393073
  hyper
tttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatc

SEQ ID NO: 13251 - DNA, 398 bp, Homo sapiens; identical to SEQ ID NO: 4604
  chr19:17501241-17501639
  hyper

SEQ ID NO: 13252 - DNA, 131 bp, Homo sapiens
  chr19:17717050-17717181
  hyper
cacgcagctgcagcacggccagccccaccgtgcggtcctcgcgcgcgaagcagtagtccttgacgcacacctgcagctcatagcactcgggacccgcgtcggcgctcagcgtgctgcgtggggaggggcgg

SEQ ID NO: 13253 - DNA, 104 bp, Homo sapiens
  chr19:17717404-17717508
  hyper
ccaccgaaaaatgaccgcatagttttacatccagctcccgcccctcagacaccgccctgcaaggccatgctcccaccctgagatacccgcgcctgtgccctctg

SEQ ID NO: 13254 - DNA, 296 bp, Homo sapiens
  chr19:17958515-17958811
  hyper
tgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgaga

SEQ ID NO: 13255 - DNA, 149 bp, Homo sapiens
  chr19:17983002-17983151
  hyper
gcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccgggga

SEQ ID NO: 13256 - DNA, 192 bp, Homo sapiens
  chr19:17983474-17983666
  hyper
gcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcc

SEQ ID NO: 13257 - DNA, 41 bp, Homo sapiens
  chr19:18077737-18077778
  hyper
gcaagagggggagttcgaagaccagccgcatgccggggggt

SEQ ID NO: 13258 - DNA, 39 bp, Homo sapiens
  chr19:18078233-18078272
  hyper
aagagggagggtctccgtgcggtccggagcctaggagac

SEQ ID NO: 13259 - DNA, 371 bp, Homo sapiens
  chr19:18343439-18343810
  hyper
atacccaagcatgaacgtacaggagcaccccaaacacatctggtcaccccagtctcacgcgcgcgcgcgcacacacacacacactctttcagtcccaaccgcacgtgggcacacccggtcacacagacccacaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggc

SEQ ID NO: 13260 - DNA, 84 bp, Homo sapiens
  chr19:18343879-18343963
  hyper
cggatggggcgccggggttgccgccacaggtgcttcggggctctggtcatgctgtggcggccgcgagagcgactcaacctgctg

SEQ ID NO: 13261 - DNA, 29 bp, Homo sapiens
  chr19:18714552-18714581
  hyper
ggggcaaacttggctcgagggctctgtct

SEQ ID NO: 13262 - DNA, 11 bp, Homo sapiens
  chr19:18715071-18715082
  hyper
gcgggggacac

SEQ ID NO: 13263 - DNA, 2 bp, Homo sapiens
  chr19:18898231-18898233
  hyper
cc

SEQ ID NO: 13264 - DNA, 112 bp, Homo sapiens
  chr19:18899103-18899215
  hyper
agttgggcacagtcacgcagttgtcctgggggcgggcacagaaggtgtgaggggcgcggtcatgaagtcccgccctccctcctgcccaagcccgccccgctccgcccccacc

SEQ ID NO: 13265 - DNA, 30 bp, Homo sapiens
  chr19:18900810-18900840
  hyper
gcgcgcgccgctctccgtctggatgcaggc

SEQ ID NO: 13266 - DNA, 606 bp, Homo sapiens; identical to SEQ ID NO: 4605
  chr19:18901603-18902209
  hyper

SEQ ID NO: 13267 - DNA, 30 bp, Homo sapiens
  chr19:19006120-19006150
  hyper
cgctccgggccggggcgcagcccgcatggc

SEQ ID NO: 13268 - DNA, 131 bp, Homo sapiens
  chr19:19006691-19006822
  hyper
ccagcagcagcagctcgggcggcgccaggtgcgcgtgctcagccaggccgcgacgcgccagcccccagccgcagtccgtgcagccccgcgccgccgccagcgcgctgccccagccgcgctgcactagctgc

SEQ ID NO: 13269 - DNA, 50 bp, Homo sapiens
  chr19:19322879-19322929
  hyper
gatccgtgagggggccgtgttgcgggagaagacttcgggattagagacag

SEQ ID NO: 13270 - DNA, 54 bp, Homo sapiens
  chr19:19649100-19649154
  hyper
agttggacccgagcacgccgcggagcccggaccctccctcggacgctctgcccc

SEQ ID NO: 13271 - DNA, 336 bp, Homo sapiens; identical to SEQ ID NO: 4606
  chr19:19651512-19651848
  hyper

SEQ ID NO: 13272 - DNA, 50 bp, Homo sapiens; identical to SEQ ID NO: 4607
  chr19:19651990-19652040
  hyper

SEQ ID NO: 13273 - DNA, 30 bp, Homo sapiens
  chr19:19932203-19932233
  hyper
aaagacaggacaccccggggacccgctgtc

SEQ ID NO: 13274 - DNA, 29 bp, Homo sapiens
  chr19:19932565-19932594
  hyper
gccaaagccggaagccggaaaccgtcctg

SEQ ID NO: 13275 - DNA, 120 bp, Homo sapiens
  chr19:20012036-20012156
  hyper
ggttcccttcagccataagatggcggctgcgcttatagcgcagcccccaggcgtcctgtctcttcactgtgcggtgactgtgccctggcttggagccctcgctgggcagctgcgcacccg

SEQ ID NO: 13276 - DNA, 408 bp, Homo sapiens
  chr19:20149780-20150188
  hyper
aagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagct

SEQ ID NO: 13277 - DNA, 148 bp, Homo sapiens
  chr19:20162757-20162905
  hyper
ggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagc

SEQ ID NO: 13278 - DNA, 388 bp, Homo sapiens
  chr19:20162906-20163294
  hyper
cgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagag

SEQ ID NO: 13279 - DNA, 30 bp, Homo sapiens
  chr19:20188913-20188943
  hyper
cagctgagggacccccggaagcctagaaat

SEQ ID NO: 13280 - DNA, 300 bp, Homo sapiens; identical to SEQ ID NO: 4608
  chr19:22018420-22018720
  hyper

SEQ ID NO: 13281 - DNA, 58 bp, Homo sapiens; identical to SEQ ID NO: 4609
  chr19:22018900-22018958
  hyper

SEQ ID NO: 13282 - DNA, 61 bp, Homo sapiens; identical to SEQ ID NO: 4610
  chr19:22018959-22019020
  hyper

SEQ ID NO: 13283 - DNA, 28 bp, Homo sapiens
  chr19:22019080-22019108
  hyper
aaggtcctgcccccgcaaaccctgaatg

SEQ ID NO: 13284 - DNA, 39 bp, Homo sapiens; identical to SEQ ID NO: 4612
  chr19:22034379-22034418
  hyper

SEQ ID NO: 13285 - DNA, 3 bp, Homo sapiens
  chr19:22034419-22034422
  hyper
agt

SEQ ID NO: 13286 - DNA, 592 bp, Homo sapiens; identical to SEQ ID NO: 4614
  chr19:22034446-22035038
  hyper

SEQ ID NO: 13287 - DNA, 404 bp, Homo sapiens
  chr19:22715206-22715610
  hyper
gtggggttggggccacgtcagctagattgcggcttaccactggggaacaattcctgtcggccaccgcgcaactgtgcgactgaccagaggaggcgtaaccagggcctactacagcgcagaatagggggcgtggccgccatcctccaagtccattggtcgatgagaaagatgacagagaaaggaggcgaggccaggcagcagcgcgtccaggtgggtgtgaggcgtcacaaggaaagctgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagag

SEQ ID NO: 13288 - DNA, 6 bp, Homo sapiens
  chr19:22806297-22806303
  hyper
cgcggg

SEQ ID NO: 13289 - DNA, 67 bp, Homo sapiens
  chr19:23254158-23254225
  hyper
ttcagctgaaggctgcgggccttcccgagctccgcccagctcacagcggggacggtccctccctcgg

SEQ ID NO: 13290 - DNA, 256 bp, Homo sapiens; identical to SEQ ID NO: 1364
  chr19:23257752-23258008
  hyper

SEQ ID NO: 13291 - DNA, 287 bp, Homo sapiens; identical to SEQ ID NO: 1365
  chr19:23258305-23258592
  hyper

SEQ ID NO: 13292 - DNA, 79 bp, Homo sapiens; identical to SEQ ID NO: 1366
  chr19:23258652-23258731
  hyper

SEQ ID NO: 13293 - DNA, 218 bp, Homo sapiens; identical to SEQ ID NO: 4618
  chr19:23299712-23299930
  hyper

SEQ ID NO: 13294 - DNA, 16 bp, Homo sapiens
  chr19:23300338-23300354
  hyper
gcgttcccaattcctc

SEQ ID NO: 13295 - DNA, 30 bp, Homo sapiens
  chr19:23386702-23386732
  hyper
aggccggagtctgcccggcccagcccctcc

SEQ ID NO: 13296 - DNA, 38 bp, Homo sapiens
  chr19:23598448-23598486
  hyper
aatctgggaaacactcggggctgcgtgcagagctgccc

SEQ ID NO: 13297 - DNA, 30 bp, Homo sapiens
  chr19:23598726-23598756
  hyper
ttagctgtctgtgcacgtcccaggacctgc

SEQ ID NO: 13298 - DNA, 86 bp, Homo sapiens
  chr19:23654103-23654189
  hyper
cgcatcgaggatgtgacccattccctggccaagggtgtgggtggggaacggcaaccgatctcactgcctggcggggcagcttcctt

SEQ ID NO: 13299 - DNA, 391 bp, Homo sapiens; identical to SEQ ID NO: 1367
  chr19:30015572-30015963
  hyper

SEQ ID NO: 13300 - DNA, 724 bp, Homo sapiens; identical to SEQ ID NO: 1368
  chr19:30016024-30016748
  hyper

SEQ ID NO: 13301 - DNA, 59 bp, Homo sapiens; identical to SEQ ID NO: 1369
  chr19:30017451-30017510
  hyper

SEQ ID NO: 13302 - DNA, 145 bp, Homo sapiens; identical to SEQ ID NO: 1370
  chr19:30017577-30017722
  hyper

SEQ ID NO: 13303 - DNA, 967 bp, Homo sapiens; identical to SEQ ID NO: 1371
  chr19:30017765-30018732
  hyper

SEQ ID NO: 13304 - DNA, 416 bp, Homo sapiens; identical to SEQ ID NO: 1372
  chr19:30019113-30019529
  hyper

SEQ ID NO: 13305 - DNA, 81 bp, Homo sapiens; identical to SEQ ID NO: 1373
  chr19:30019530-30019611
  hyper

SEQ ID NO: 13306 - DNA, 252 bp, Homo sapiens; identical to SEQ ID NO: 1374
  chr19:30019660-30019912
  hyper

SEQ ID NO: 13307 - DNA, 153 bp, Homo sapiens; identical to SEQ ID NO: 4627
  chr19:30020190-30020343
  hyper

SEQ ID NO: 13308 - DNA, 103 bp, Homo sapiens
  chr19:30021252-30021355
  hyper
cgccgggacgccccggggggctccggacccaggacccgccccctgggcgcatttgcatatgcatactccttcctagttaggtcgggagcgccccccccagggc

SEQ ID NO: 13309 - DNA, 339 bp, Homo sapiens
  chr19:30215072-30215411
  hyper
tgccagggggagctgcgcggggcaggcccggggtaccagaggcccttgctttagcggcggccctgcgtgtgccagaggcttgcagagtgatctgagcacgccaagagattgctgtcaagtaagctcctccacaaatctgcagaaacctcaaagattacagcgctcgcacggcaggagcgcagcggcttcccatacgccggcagacaatggggcggaggaaggaaggggacggtggcctggggacccccgcgcccgcagcacgtgcaccgagcctggagcgcccgctttacagatcttgtcgctccacccctaaaacaaaggccccggggccccatctgt

SEQ ID NO: 13310 - DNA, 135 bp, Homo sapiens; identical to SEQ ID NO: 4628
  chr19:30713458-30713593
  hyper

SEQ ID NO: 13311 - DNA, 123 bp, Homo sapiens; identical to SEQ ID NO: 4629
  chr19:30713685-30713808
  hyper

SEQ ID NO: 13312 - DNA, 476 bp, Homo sapiens; identical to SEQ ID NO: 4630
  chr19:30715393-30715869
  hyper

SEQ ID NO: 13313 - DNA, 457 bp, Homo sapiens; identical to SEQ ID NO: 1375
  chr19:30716313-30716770
  hyper

SEQ ID NO: 13314 - DNA, 779 bp, Homo sapiens; identical to SEQ ID NO: 1376
  chr19:30716952-30717731
  hyper

SEQ ID NO: 13315 - DNA, 833 bp, Homo sapiens
  chr19:30717942-30718775
  hyper
aaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcg

SEQ ID NO: 13316 - DNA, 756 bp, Homo sapiens; identical to SEQ ID NO: 1377
  chr19:30719283-30720039
  hyper

SEQ ID NO: 13317 - DNA, 330 bp, Homo sapiens; identical to SEQ ID NO: 4634
  chr19:30865695-30866025
  hyper

SEQ ID NO: 13318 - DNA, 91 bp, Homo sapiens
  chr19:31839837-31839928
  hyper
cggctcagcgcgctccgcgagcggctccccaaatgggtgcgagagggaagagggcagagcgcggcggggcgtccggggggcgcccggtacc

SEQ ID NO: 13319 - DNA, 102 bp, Homo sapiens
  chr19:31839941-31840043
  hyper
cgcacccaaacaggagagcggcgcccggagttactcagtgcgggcagaagagcggggcgaggagcggggtcgcgcccgctggaggcgcggggcgagcggagg

SEQ ID NO: 13320 - DNA, 30 bp, Homo sapiens
  chr19:31840866-31840896
  hyper
ccgcccctccgcctccgccccgtgcgcaca

SEQ ID NO: 13321 - DNA, 37 bp, Homo sapiens
  chr19:31841109-31841146
  hyper
cagggaggaggcgggcgcgggccggggcgggtggggg

SEQ ID NO: 13322 - DNA, 30 bp, Homo sapiens
  chr19:31841471-31841501
  hyper
ccgcgcccggcctgccggggctgctggact

SEQ ID NO: 13323 - DNA, 122 bp, Homo sapiens
  chr19:31842359-31842481
  hyper
gcggggcagggagtccgaggcgggctgcggcggggctctcgggctggcggactcgggggctgaggcgccgtgcgcgttgggtgcccgcggccgcagaggccagaaccgctactcctccaggc

SEQ ID NO: 13324 - DNA, 146 bp, Homo sapiens; identical to SEQ ID NO: 4635
  chr19:32715595-32715741
  hyper

SEQ ID NO: 13325 - DNA, 360 bp, Homo sapiens; identical to SEQ ID NO: 4636
  chr19:33166988-33167348
  hyper

SEQ ID NO: 13326 - DNA, 296 bp, Homo sapiens
  chr19:34112434-34112730
  hyper
gctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatc

SEQ ID NO: 13327 - DNA, 15 bp, Homo sapiens
  chr19:34113288-34113303
  hyper
ggccccggactgcac

SEQ ID NO: 13328 - DNA, 33 bp, Homo sapiens
  chr19:34113879-34113912
  hyper
cgagccgagctctgacggcggctgcaactccgg

SEQ ID NO: 13329 - DNA, 66 bp, Homo sapiens
  chr19:34288609-34288675
  hyper
ccggcggcccccacccgcgactgcagaaagataagcttcaagttttcgctccgtatctcaaatgtg

SEQ ID NO: 13330 - DNA, 41 bp, Homo sapiens
  chr19:34973656-34973697
  hyper
gggtgcagcagtgcacggggttgggacgaggaaggtgcatc

SEQ ID NO: 13331 - DNA, 30 bp, Homo sapiens
  chr19:35068705-35068735
  hyper
tccccgcccctgccccgcccccagcccctc

SEQ ID NO: 13332 - DNA, 151 bp, Homo sapiens
  chr19:35263633-35263784
  hyper
agaagcacagagtcccggcatccgccgtattacagcggatgggtgcatgcgggcggtgacccgagctcgcgcgggctgcggaaccctccactcaccaacgccggcgccgccatgggcccagggggctgggtgaggccgtgagagtcggcga

SEQ ID NO: 13333 - DNA, 191 bp, Homo sapiens
  chr19:35396250-35396441
  hyper
cgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtg

SEQ ID NO: 13334 - DNA, 126 bp, Homo sapiens
  chr19:35531737-35531863
  hyper
tggaggaaatgggtgcggtggaggtgggtttggctgggcacagcgggcacgtgtgggtaagcgggtggggccggttgtgcgggtggcctatctggggcaagcagccgaggccgactgtgtccggcg

SEQ ID NO: 13335 - DNA, 507 bp, Homo sapiens; identical to SEQ ID NO: 4637
  chr19:36048580-36049087
  hyper

SEQ ID NO: 13336 - DNA, 146 bp, Homo sapiens
  chr19:36335058-36335204
  hyper
gcagctgatagaggccgtcgtccgcgcgggtcacattccacagatgcagagccccgctggacaggatgcgatgccgggggccgcccgctggggaaggccagaataagggacctggcaggacctcccatccccgggacccctcccca

SEQ ID NO: 13337 - DNA, 53 bp, Homo sapiens
  chr19:36337032-36337085
  hyper
cgctgccgagatgcacgcgccgcgactcctgcggcagccgcgactcggtcacg

SEQ ID NO: 13338 - DNA, 30 bp, Homo sapiens
  chr19:36347846-36347876
  hyper
gagcgtcagaggctgcggatgagcagactt

SEQ ID NO: 13339 - DNA, 43 bp, Homo sapiens
  chr19:36351905-36351948
  hyper
cgggtaacctggacccgccgcggtggcgcgcaggtacagccct

SEQ ID NO: 13340 - DNA, 30 bp, Homo sapiens
  chr19:36361080-36361110
  hyper
aagacaaatttataacgggaagggagagtt

SEQ ID NO: 13341 - DNA, 174 bp, Homo sapiens; identical to SEQ ID NO: 4638
  chr19:36450122-36450296
  hyper

SEQ ID NO: 13342 - DNA, 15 bp, Homo sapiens
  chr19:36450544-36450559
  hyper
cgccccagggtcgct

SEQ ID NO: 13343 - DNA, 73 bp, Homo sapiens; identical to SEQ ID NO: 4640
  chr19:36523333-36523406
  hyper

SEQ ID NO: 13344 - DNA, 93 bp, Homo sapiens
  chr19:36523623-36523716
  hyper
acctcgggcagacagcgctggggaccaaagtggagactggggagactgtgggagcaatggggtgtcggtgtcaggggacgtgatgggggaggc

SEQ ID NO: 13345 - DNA, 84 bp, Homo sapiens; identical to SEQ ID NO: 4641
  chr19:36736319-36736403
  hyper

SEQ ID NO: 13346 - DNA, 225 bp, Homo sapiens; identical to SEQ ID NO: 4642
  chr19:36822242-36822467
  hyper

SEQ ID NO: 13347 - DNA, 146 bp, Homo sapiens; identical to SEQ ID NO: 4643
  chr19:36822557-36822703
  hyper

SEQ ID NO: 13348 - DNA, 280 bp, Homo sapiens; identical to SEQ ID NO: 1378
  chr19:36909069-36909349
  hyper

SEQ ID NO: 13349 - DNA, 244 bp, Homo sapiens; identical to SEQ ID NO: 1379
  chr19:36909623-36909867
  hyper

SEQ ID NO: 13350 - DNA, 15 bp, Homo sapiens
  chr19:36912335-36912350
  hyper
ggcaccaggggacgc

SEQ ID NO: 13351 - DNA, 15 bp, Homo sapiens
  chr19:36912480-36912495
  hyper
cgagacaagccggtg

SEQ ID NO: 13352 - DNA, 33 bp, Homo sapiens; identical to SEQ ID NO: 4646
  chr19:37096487-37096520
  hyper

SEQ ID NO: 13353 - DNA, 560 bp, Homo sapiens
  chr19:37157617-37158177
  hyper
gtccaagctctgattcggattccaagcgaagccacacgcccagctcttccttctccaccggcccgggacatccttacctgcctctacccggagaccattcctgcgaggctcctaccggaagtagctgtggacagcagtgtcctctgggaaatgcagtccgaggggagagcgcctggggtggagcgggtgtgttccgccgggctccgggatgcacttgcgcagtttcacccgaggctggagtgacgccaacctgttaatgttcgttttcggattctggacttcgggttccgctgaggacggatttcggaataggcacagtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaacgatttaaaaaaaaattttttttttggccgggcgcggtgg

SEQ ID NO: 13354 - DNA, 66 bp, Homo sapiens
  chr19:37263373-37263439
  hyper
acccaccccgggacacgcagtccaaccacacagtcaccggttcttcacatccgcacgcacaacgag

SEQ ID NO: 13355 - DNA, 37 bp, Homo sapiens
  chr19:37263751-37263788
  hyper
cgcgagacgtggcgtcggcctgcgggatcctctggga

SEQ ID NO: 13356 - DNA, 171 bp, Homo sapiens; identical to SEQ ID NO: 1380
  chr19:37264222-37264393
  hyper

SEQ ID NO: 13357 - DNA, 25 bp, Homo sapiens
  chr19:37287936-37287961
  hyper
tttgttttttgaaaccgagtttcgc

SEQ ID NO: 13358 - DNA, 224 bp, Homo sapiens; identical to SEQ ID NO: 1382
  chr19:37288201-37288425
  hyper

SEQ ID NO: 13359 - DNA, 99 bp, Homo sapiens; identical to SEQ ID NO: 1383
  chr19:37288606-37288705
  hyper

SEQ ID NO: 13360 - DNA, 59 bp, Homo sapiens; identical to SEQ ID NO: 1384
  chr19:37288706-37288765
  hyper

SEQ ID NO: 13361 - DNA, 112 bp, Homo sapiens
  chr19:37329256-37329368
  hyper
gatggtggaaggttccgcgatctttctattaaccctaaagggacagagggctgacaggaagttgcccggggaacggtgcactctgggaaatgtagtccggagcctgggccgt

SEQ ID NO: 13362 - DNA, 32 bp, Homo sapiens
  chr19:37342101-37342133
  hyper
gtgaggttcctggaccgcggttgtgactgtat

SEQ ID NO: 13363 - DNA, 108 bp, Homo sapiens; identical to SEQ ID NO: 4652
  chr19:37406765-37406873
  hyper

SEQ ID NO: 13364 - DNA, 71 bp, Homo sapiens; identical to SEQ ID NO: 1385
  chr19:37407081-37407152
  hyper

SEQ ID NO: 13365 - DNA, 221 bp, Homo sapiens; identical to SEQ ID NO: 1386
  chr19:37407153-37407374
  hyper

SEQ ID NO: 13366 - DNA, 68 bp, Homo sapiens; identical to SEQ ID NO: 1387
  chr19:37407375-37407443
  hyper

SEQ ID NO: 13367 - DNA, 271 bp, Homo sapiens
  chr19:37464095-37464366
  hyper
gtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggat

SEQ ID NO: 13368 - DNA, 61 bp, Homo sapiens
  chr19:37464666-37464727
  hyper
cgtgtgccgggtcatcgaccccatctttgggaggcctgggagggggcgggacaccctcgct

SEQ ID NO: 13369 - DNA, 809 bp, Homo sapiens
  chr19:37957671-37958480
  hyper
tcccactgtcatgcacgtttgcacgcaggttcatactgaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccgaccccacctgcaaaaaggcacttccttcttacagtcggctggagctgcaggttcgcaaggtccgtgaaggaagcccggctcagtgtgttt

SEQ ID NO: 13370 - DNA, 572 bp, Homo sapiens
  chr19:37959933-37960505
  hyper
gggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 13371 - DNA, 153 bp, Homo sapiens; identical to SEQ ID NO: 4656
  chr19:37997838-37997991
  hyper

SEQ ID NO: 13372 - DNA, 117 bp, Homo sapiens; identical to SEQ ID NO: 4657
  chr19:37997992-37998109
  hyper

SEQ ID NO: 13373 - DNA, 201 bp, Homo sapiens; identical to SEQ ID NO: 4658
  chr19:38042365-38042566
  hyper

SEQ ID NO: 13374 - DNA, 35 bp, Homo sapiens
  chr19:38146647-38146682
  hyper
ttttcatttggttctcggctcggagacaggcggag

SEQ ID NO: 13375 - DNA, 209 bp, Homo sapiens
  chr19:38147011-38147220
  hyper
cccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcgg

SEQ ID NO: 13376 - DNA, 129 bp, Homo sapiens
  chr19:38182831-38182960
  hyper
gcgggcactcactctcgctcacactacaatcagatcctccatgcggctttcatatactctgtcacactcgcagccagaatcccctcggatggactcttgcaaacctccagccccatcccgggatccgtg

SEQ ID NO: 13377 - DNA, 33 bp, Homo sapiens
  chr19:38183111-38183144
  hyper
cgctcccacgtctccgggcgcagcttgtgccag

SEQ ID NO: 13378 - DNA, 34 bp, Homo sapiens; identical to SEQ ID NO: 4659
  chr19:38183440-38183474
  hyper

SEQ ID NO: 13379 - DNA, 83 bp, Homo sapiens
  chr19:38210615-38210698
  hyper
gcgcctcccacccaccgctcgagccccggagacttctgggagtggccgccttgcctcgagtgcgcatgcgcagatcggccact

SEQ ID NO: 13380 - DNA, 73 bp, Homo sapiens
  chr19:38308247-38308320
  hyper
tggggctgctggaggcgttcagagcgcggaggccccaggcgcgggccgggctctctcccgcctcctcaggccc

SEQ ID NO: 13381 - DNA, 30 bp, Homo sapiens
  chr19:38701199-38701229
  hyper
ccaccttatcgccaccgctgatttgcccca

SEQ ID NO: 13382 - DNA, 500 bp, Homo sapiens
  chr19:38701550-38702050
  hyper
taggggctggctggtcgcctcacccccaacaaggcccgtcgacccccggtcctccttcttggtgatgccccaaaccagacgggagaacgaggcagtcgtgggcagaggggtcaggcccagtttaatacacagaacaagttaattcacagcagaggcaggcaatagaggagactcggtgacaagtgagggggcactcctggattaggggacatccccccaaaacccaccacctcccccacctgcagtctcagtttcccttttttaaaacccgaacaacaaacacacacaaccacaagaaacaaccacgccccctcactcccccaaaatggccagcgaggggggcgggggccgccaggcctggcggggcgggaggagggagagaaaaggagtccgtggcggagtctgtgcttctcattccagcaggcgctgggcgggggcccacccggccccaccaccgccacccaccagccacggcaggcacggggcgggcacaggctggg

SEQ ID NO: 13383 - DNA, 290 bp, Homo sapiens
  chr19:38746788-38747078
  hyper
tacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggct

SEQ ID NO: 13384 - DNA, 95 bp, Homo sapiens
  chr19:38747106-38747201
  hyper
cggccgcctcaggcctcagtttccccgtctgcagtgcgagagtaggccgctgcgtcggcttgaggcacgcagtcgtgcgaagttgaggtatgggc

SEQ ID NO: 13385 - DNA, 190 bp, Homo sapiens
  chr19:38747202-38747392
  hyper
gggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttcct

SEQ ID NO: 13386 - DNA, 36 bp, Homo sapiens
  chr19:38877852-38877888
  hyper
cttttcgggagcccccgcccgcggatggctccgact

SEQ ID NO: 13387 - DNA, 39 bp, Homo sapiens
  chr19:38924397-38924436
  hyper
ccctcccgcccagcccgcagccccctccctctgttcccc

SEQ ID NO: 13388 - DNA, 95 bp, Homo sapiens
  chr19:38924437-38924532
  hyper
acctcagaccctgggcttccgacctcgacatcatgggtgacgcagaaggcgaagacgaggtccagttcctgcggacggtgcgtatctctgggtta

SEQ ID NO: 13389 - DNA, 55 bp, Homo sapiens
  chr19:39282953-39283008
  hyper
caccctcggggcagacgcgatggcagcggccccggctctgcggaacagctgggag

SEQ ID NO: 13390 - DNA, 39 bp, Homo sapiens
  chr19:39466291-39466330
  hyper
agtcgaggggctccccgtgatcggcgtggcccagggggc

SEQ ID NO: 13391 - DNA, 42 bp, Homo sapiens
  chr19:39589777-39589819
  hyper
tgtgggtgaggcatccgcaggggcgcgcgcagggacggtggg

SEQ ID NO: 13392 - DNA, 28 bp, Homo sapiens
  chr19:39687619-39687647
  hyper
gggatggaggaggtgcgtgagggacacg

SEQ ID NO: 13393 - DNA, 204 bp, Homo sapiens
  chr19:39687755-39687959
  hyper
cgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaag

SEQ ID NO: 13394 - DNA, 347 bp, Homo sapiens; identical to SEQ ID NO: 1388
  chr19:39754886-39755233
  hyper

SEQ ID NO: 13395 - DNA, 156 bp, Homo sapiens; identical to SEQ ID NO: 1389
  chr19:39755264-39755420
  hyper

SEQ ID NO: 13396 - DNA, 366 bp, Homo sapiens
  chr19:39989752-39990118
  hyper
gtcctggggaaggagcgtggggcggacgggaagcctgggtcctcccggccgcctcaccctgcgcccgtctccgtcccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctgtaag

SEQ ID NO: 13397 - DNA, 223 bp, Homo sapiens; identical to SEQ ID NO: 4662
  chr19:39993434-39993657
  hyper

SEQ ID NO: 13398 - DNA, 32 bp, Homo sapiens; identical to SEQ ID NO: 4663
  chr19:39997701-39997733
  hyper

SEQ ID NO: 13399 - DNA, 238 bp, Homo sapiens; identical to SEQ ID NO: 4664
  chr19:39997748-39997986
  hyper

SEQ ID NO: 13400 - DNA, 54 bp, Homo sapiens
  chr19:40005850-40005904
  hyper
ccatgaataaccaggcgcggaccccagccccctcctcggcgcggacttcaacct

SEQ ID NO: 13401 - DNA, 63 bp, Homo sapiens
  chr19:40006576-40006639
  hyper
ccttacagaattgtacggaaaccttcccctcctccagcgagaacttcgcgctggacaagaggg

SEQ ID NO: 13402 - DNA, 279 bp, Homo sapiens; identical to SEQ ID NO: 4665
  chr19:40724000-40724279
  hyper

SEQ ID NO: 13403 - DNA, 84 bp, Homo sapiens
  chr19:41018532-41018616
  hyper
caggtcatctgcaaccgcgtgaaccacgtgcacggctgcctggcggagctgcaggagcaggcagcgcggcgacgcgcggagctg

SEQ ID NO: 13404 - DNA, 333 bp, Homo sapiens
  chr19:41025379-41025712
  hyper
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactg

SEQ ID NO: 13405 - DNA, 278 bp, Homo sapiens
  chr19:41059971-41060249
  hyper
ccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtgga

SEQ ID NO: 13406 - DNA, 111 bp, Homo sapiens; identical to SEQ ID NO: 4666
  chr19:41073569-41073680
  hyper

SEQ ID NO: 13407 - DNA, 6 bp, Homo sapiens
  chr19:41119403-41119409
  hyper
ccgacc

SEQ ID NO: 13408 - DNA, 59 bp, Homo sapiens
  chr19:41354396-41354455
  hyper
ccagggctggaagtgcgggcgcctttccccacctagtccccatccccaggcagaacgcg

SEQ ID NO: 13409 - DNA, 162 bp, Homo sapiens
  chr19:41354575-41354737
  hyper
cgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaag

SEQ ID NO: 13410 - DNA, 53 bp, Homo sapiens
  chr19:41596078-41596131
  hyper
cgacgccctccggggcacgcacggtgagtaggggaccccgagtgcgagggcgg

SEQ ID NO: 13411 - DNA, 173 bp, Homo sapiens
  chr19:41641726-41641899
  hyper
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgt

SEQ ID NO: 13412 - DNA, 459 bp, Homo sapiens
  chr19:42028283-42028742
  hyper
tctaaaacaaaccaacgaggctgccaacctgtgagatagttggtccacttgtacaaaaccccctccatgcttcagagccccacaccgctcatcctcccggcccggcgccggccgcggtgatggggtaggcgcggggcctggggcagcctttcccggcccgcccgggccccctccgccggcacgaagccgctttctgcctgcgcgcgccgcagggacgtggcggcccttagaggccgggacagcgggcgcagcgtggagcttgggggccgcgaggcgcgggctcagacatccccgggtaagcctcggcggcggcggccgcgacaacggcaaaaatgcgactgcgaccgcgaccggtctcgtgctcgcgcttccgcggcccggctgctccctccggcgccccggcgctgcctcttcctcgcctgccttccttccccctgggctccccgtttgtttttcgac

SEQ ID NO: 13413 - DNA, 30 bp, Homo sapiens
  chr19:42574121-42574151
  hyper
ggtggaagagaaaggcggaggagggtgggg

SEQ ID NO: 13414 - DNA, 133 bp, Homo sapiens
  chr19:42636456-42636589
  hyper
ggggcaggcagggcccgcagagcaaacctaaatgtgctgcctgtcctctgagcagtggcacaggcaccagcccccttacctggagcccccatgctggagtgaaccatgctgcccgccccgccagggctggggg

SEQ ID NO: 13415 - DNA, 19 bp, Homo sapiens
  chr19:42828316-42828335
  hyper
cgtgcgtccacacctgggg

SEQ ID NO: 13416 - DNA, 68 bp, Homo sapiens
  chr19:42906129-42906197
  hyper
aggtcctccaccacgcgcagcgtcaccggctggcccaggttgcgcagtcgccgcgcgagcatgaccga

SEQ ID NO: 13417 - DNA, 64 bp, Homo sapiens
  chr19:42928276-42928340
  hyper
ctagttctcctattgcgcttttcctgggggatctttctccctctgtctccgccccctaatccat

SEQ ID NO: 13418 - DNA, 30 bp, Homo sapiens
  chr19:44203678-44203708
  hyper
accctgtctccgtctcggcaggcggccgga

SEQ ID NO: 13419 - DNA, 41 bp, Homo sapiens
  chr19:44324840-44324881
  hyper
tgggaattgtagtcccgggccggaaacgcaggagacgccag

SEQ ID NO: 13420 - DNA, 16 bp, Homo sapiens
  chr19:44405908-44405924
  hyper
tgatttctgtggagac

SEQ ID NO: 13421 - DNA, 141 bp, Homo sapiens
  chr19:44405925-44406066
  hyper
atctactcaccacgtaggggctacagcagctcggacaccggaaaaagatctagagctcgagggtgaccctagcgcggtgacttctgggaaatgtagtccacccggaataaccatgtccacggcgcccgccattctgtagcc

SEQ ID NO: 13422 - DNA, 414 bp, Homo sapiens
  chr19:44711532-44711946
  hyper
gaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggtt

SEQ ID NO: 13423 - DNA, 30 bp, Homo sapiens
  chr19:44905499-44905529
  hyper
ggctgctccccaaaccgagcccacgctcga

SEQ ID NO: 13424 - DNA, 30 bp, Homo sapiens
  chr19:44952282-44952312
  hyper
ccacaagtgggtgggcggctaccctgagaa

SEQ ID NO: 13425 - DNA, 33 bp, Homo sapiens
  chr19:44952519-44952552
  hyper
tgggcttcgaccctccgccgcacgttgtccctt

SEQ ID NO: 13426 - DNA, 32 bp, Homo sapiens
  chr19:45655399-45655431
  hyper
cggcttgagcgcgctgacggctcggatgagac

SEQ ID NO: 13427 - DNA, 616 bp, Homo sapiens; identical to SEQ ID NO: 1390
  chr19:45655778-45656394
  hyper

SEQ ID NO: 13428 - DNA, 61 bp, Homo sapiens; identical to SEQ ID NO: 4668
  chr19:45656682-45656743
  hyper

SEQ ID NO: 13429 - DNA, 166 bp, Homo sapiens; identical to SEQ ID NO: 4669
  chr19:45656790-45656956
  hyper

SEQ ID NO: 13430 - DNA, 41 bp, Homo sapiens
  chr19:45657177-45657218
  hyper
taaagagctggaagccggtgcagaagcgggggcgtggagag

SEQ ID NO: 13431 - DNA, 30 bp, Homo sapiens
  chr19:45755404-45755434
  hyper
tctgcccctccaggacgcacccagggcgcc

SEQ ID NO: 13432 - DNA, 361 bp, Homo sapiens; identical to SEQ ID NO: 1391
  chr19:45888864-45889225
  hyper

SEQ ID NO: 13433 - DNA, 82 bp, Homo sapiens; identical to SEQ ID NO: 1392
  chr19:45889315-45889397
  hyper

SEQ ID NO: 13434 - DNA, 178 bp, Homo sapiens
  chr19:46001719-46001897
  hyper
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgca

SEQ ID NO: 13435 - DNA, 256 bp, Homo sapiens
  chr19:46002097-46002353
  hyper
tccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacg

SEQ ID NO: 13436 - DNA, 54 bp, Homo sapiens
  chr19:46105244-46105298
  hyper
gactgaggcagcccccgagggggcggggaggagcggtctcgccacgagcagggc

SEQ ID NO: 13437 - DNA, 173 bp, Homo sapiens
  chr19:46379903-46380076
  hyper
gctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtct

SEQ ID NO: 13438 - DNA, 93 bp, Homo sapiens
  chr19:46476967-46477060
  hyper
gcaggatggcagggccgaggggggtctccgatagggccgggaaagaactgagaggtggggtctctcctgggaccacagaggctggggactgga

SEQ ID NO: 13439 - DNA, 110 bp, Homo sapiens
  chr19:46519300-46519410
  hyper
tgtggtctcaggaggcggactccgccggtgcagccgcccccgacgcgggaggaccgggcctcatcgtcccgggagcgctccgcgtcgcgaggccgcggcgccgcgcgctc

SEQ ID NO: 13440 - DNA, 61 bp, Homo sapiens
  chr19:46907548-46907609
  hyper
cccctggagggagtgcgcccaggaagtggggaggagcgtttgagatcgaaggagtggccgc

SEQ ID NO: 13441 - DNA, 197 bp, Homo sapiens; identical to SEQ ID NO: 4672
  chr19:46916791-46916988
  hyper

SEQ ID NO: 13442 - DNA, 83 bp, Homo sapiens
  chr19:46930064-46930147
  hyper
tggtctccatagcaacggtcggacgcgctgctaggttctggctctgactgcgcctgcgcggctggtcccgcggggtctcccga

SEQ ID NO: 13443 - DNA, 84 bp, Homo sapiens
  chr19:46932252-46932336
  hyper
tcctctgccattggccgactggccgcattgaaatcaagagtctgagggggtcattcggaggtgaggggtcggccaccagccctc

SEQ ID NO: 13444 - DNA, 41 bp, Homo sapiens
  chr19:46974568-46974609
  hyper
ctccgcctgcccagccgggacttacttggcagatcagcctc

SEQ ID NO: 13445 - DNA, 7 bp, Homo sapiens
  chr19:46993254-46993261
  hyper
cctaagc

SEQ ID NO: 13446 - DNA, 107 bp, Homo sapiens
  chr19:46993281-46993388
  hyper
cgccacgcccacctgcccccatgccgcataggtccccacagccaccgctcagggccctctgcaggggctgctgctgctgcaagcccacggggcgctggggggagttt

SEQ ID NO: 13447 - DNA, 36 bp, Homo sapiens
  chr19:46996615-46996651
  hyper
cgtcgggatcgctggcgcccccggcctgcgagggcc

SEQ ID NO: 13448 - DNA, 4 bp, Homo sapiens
  chr19:47152987-47152991
  hyper
ggcc

SEQ ID NO: 13449 - DNA, 145 bp, Homo sapiens
  chr19:47523113-47523258
  hyper
ctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtag

SEQ ID NO: 13450 - DNA, 37 bp, Homo sapiens
  chr19:47523631-47523668
  hyper
tccggggctggggctcgcgcgccggggtcttcaggga

SEQ ID NO: 13451 - DNA, 30 bp, Homo sapiens
  chr19:47921726-47921756
  hyper
cctgtcttctatccccgttcccatccccag

SEQ ID NO: 13452 - DNA, 289 bp, Homo sapiens
  chr19:47933200-47933489
  hyper
agccaggggagggggcggagaagggaggccgagtcccaggagaggaggccgagtctggggggaaaaggagaccagggtccaagagcaggtgcagccgagtccctagccccgggcgggcggtggggacgagtctctgcgcgaggccctagaagccccggatgtggcagtacgcctccaggctggcgaagaggatgtacaggagccagaggcccaggaagagcgcggtggtggcgagcttgggtccgcgcgggccgcccagctcgccgccgatgtgcggccggcgccggta

SEQ ID NO: 13453 - DNA, 30 bp, Homo sapiens
  chr19:47933730-47933760
  hyper
cagagacatacaggtcggaggggctttgcg

SEQ ID NO: 13454 - DNA, 3 bp, Homo sapiens
  chr19:47960799-47960802
  hyper
cga

SEQ ID NO: 13455 - DNA, 118 bp, Homo sapiens
  chr19:48076481-48076599
  hyper
gcgcgtacgtgaccgcgggccgcctcacgcctcccagagcggcctcgcgcgtgcctcctggccgcgcgctctcggctgcttctccgaggggcggggcttgccgcgggcgggaaaggag

SEQ ID NO: 13456 - DNA, 185 bp, Homo sapiens
  chr19:48901882-48902067
  hyper
cagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgc

SEQ ID NO: 13457 - DNA, 78 bp, Homo sapiens; identical to SEQ ID NO: 1393
  chr19:48918201-48918279
  hyper

SEQ ID NO: 13458 - DNA, 30 bp, Homo sapiens
  chr19:48994837-48994867
  hyper
tcacgtcccatttaccgcatcccccaaaag

SEQ ID NO: 13459 - DNA, 195 bp, Homo sapiens
  chr19:49127373-49127568
  hyper
ccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggt

SEQ ID NO: 13460 - DNA, 118 bp, Homo sapiens
  chr19:49399231-49399349
  hyper
gccgctggattgttgcgggctccgcacgtaaagaatctcgcgccaggctctcgtaatgagaccgcgccccgccccggacccctagaccccgtctccgcaatcccgggtttggggtggg

SEQ ID NO: 13461 - DNA, 77 bp, Homo sapiens
  chr19:49924485-49924562
  hyper
ttaaaccaatgagagcgcggtccgcacgaacggcgccccaggcgcgctgatctagccctctgcggaccaccgggttg

SEQ ID NO: 13462 - DNA, 186 bp, Homo sapiens; identical to SEQ ID NO: 4674
  chr19:49925774-49925960
  hyper

SEQ ID NO: 13463 - DNA, 375 bp, Homo sapiens
  chr19:49935736-49936111
  hyper
aggctgtcctagagccggcccaggccccgccccactcacctccgcagttcatcaacttgcgcacgttggtggtggacatgatgcggcggctccgcaggaagtccgcgatctggccgccgatgggcacgatgatggtcatgaccaggtggggcagcgcggacaccaggcctacctgcgggaacaggtgtacagggacactagggttcggggccgccggctcggcgtctctgcccggtccgtgcaccaccggctcctccctgcctcgggatcgccgccagttccctcccgccgacccctccgcgcccccctgccctctcctcctgggctctaccttgctgatctcgaagccgaacacttcttcgaagtaggcgggct

SEQ ID NO: 13464 - DNA, 41 bp, Homo sapiens
  chr19:49936853-49936894
  hyper
tagcccctctctttgcgttccagtcccgtctcctctagagt

SEQ ID NO: 13465 - DNA, 296 bp, Homo sapiens
  chr19:50194182-50194478
  hyper
aggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactcct

SEQ ID NO: 13466 - DNA, 37 bp, Homo sapiens
  chr19:50194774-50194811
  hyper
ggcggggggaggggacgctgagcggatgaatttatag

SEQ ID NO: 13467 - DNA, 59 bp, Homo sapiens
  chr19:50316361-50316420
  hyper
atttaggactcccaccgcggtccctcacgtggggactgtcagtgcgggtcttggagcat

SEQ ID NO: 13468 - DNA, 290 bp, Homo sapiens; identical to SEQ ID NO: 4675
  chr19:50554012-50554302
  hyper

SEQ ID NO: 13469 - DNA, 55 bp, Homo sapiens
  chr19:50815996-50816051
  hyper
tttccccgcctccttcggctttcgtgaaggtcaggggaaacgggggggcttgtta

SEQ ID NO: 13470 - DNA, 53 bp, Homo sapiens
  chr19:50816431-50816484
  hyper
aaatgattttccacccgcgagcgtgacgcggtgaggaccgctggggaaggggg

SEQ ID NO: 13471 - DNA, 179 bp, Homo sapiens
  chr19:50818424-50818603
  hyper
agagacacaaaaggacggatgacaagagacagatggacagagatggaccaaggagatggagagagaaagtgaacaaatcggggagtcagtcaacatcgatgagaaagggggagacatcggggaggggggagagactccggattaggaggcaggttggtgcccaccgagcctcccccgcc

SEQ ID NO: 13472 - DNA, 30 bp, Homo sapiens
  chr19:50819128-50819158
  hyper
agggttctgcacccccgcagggagctctgt

SEQ ID NO: 13473 - DNA, 35 bp, Homo sapiens
  chr19:50836356-50836391
  hyper
ggatcccaagtcccccgtctccaaaactaggattc

SEQ ID NO: 13474 - DNA, 13 bp, Homo sapiens
  chr19:50836392-50836405
  hyper
ggctgtcttaccg

SEQ ID NO: 13475 - DNA, 51 bp, Homo sapiens
  chr19:51111640-51111691
  hyper
tatataattggatgccggaaatttggatcttttctacgtttcgcatttctg

SEQ ID NO: 13476 - DNA, 48 bp, Homo sapiens
  chr19:51142710-51142758
  hyper
gctggggtcccaagacgcttcaggggaggggaacgatgtccgggactt

SEQ ID NO: 13477 - DNA, 15 bp, Homo sapiens
  chr19:51142834-51142849
  hyper
cgaggggtgggatac

SEQ ID NO: 13478 - DNA, 30 bp, Homo sapiens
  chr19:51161225-51161255
  hyper
tctctctccgacacccgcagcccgaggagg

SEQ ID NO: 13479 - DNA, 331 bp, Homo sapiens
  chr19:51161720-51162051
  hyper
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagag

SEQ ID NO: 13480 - DNA, 26 bp, Homo sapiens
  chr19:51162427-51162453
  hyper
gcaccgccccgcgggctggggccacc

SEQ ID NO: 13481 - DNA, 15 bp, Homo sapiens
  chr19:51170723-51170738
  hyper
cagttttcaaggaac

SEQ ID NO: 13482 - DNA, 131 bp, Homo sapiens
  chr19:51171145-51171276
  hyper
cagggccagccccagcggggaggcgggatccagggccttgccggtcagcgggtgcaccaggggtcgcgggggcaggaagctggtgaaggcgctgctgcccccgccacccccgtaggctcggctaccggccc

SEQ ID NO: 13483 - DNA, 258 bp, Homo sapiens
  chr19:51197503-51197761
  hyper
agccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcg

SEQ ID NO: 13484 - DNA, 60 bp, Homo sapiens
  chr19:51198175-51198235
  hyper
cgctgcgccgccggggccccagggctggccagctggaggacagcgcggggggcggctgcg

(The sequence listing continues in the following parts.)

What is claimed is:

1. A method of processing cell-free DNA fragments comprising:
   a) reacting cell-free DNA fragments from a biological sample with a deaminating agent to generate converted cell-free DNA fragments;
   b) contacting the converted cell-free DNA fragments or amplification products thereof with a panel of different oligonucleotide probes configured to hybridize to converted cell-free DNA fragments derived from at least 500 target genomic regions;
   c) enriching a subset of the converted cell-free DNA fragments or amplification products thereof, wherein the enriching comprises (i) separating probe-bound DNA from unbound DNA, and (ii) amplifying the separated probe-bound DNA using a plurality of primers; and
   d) sequencing the enriched subset to obtain a set of sequence reads;
   wherein each target genomic region of the at least 500 target genomic regions has an anomalous methylation pattern in cancerous samples, and
   wherein each of the at least 500 target genomic regions comprises a sequence with complementarity to at least a pair of probes in the panel, wherein each probe of a pair has a first portion and a second portion, wherein the first portions of a probe pair are complementary to the same sequence of at least 25 nucleotides in length, and wherein the second portions of a probe pair are complementary to different sequences at different ends of the sequence complementary to the respective first portions.

2. The method of claim 1, wherein each of the at least 500 target genomic regions is determined to be anomalously methylated in cancer training samples based on criteria comprising a number of cancer samples that comprise an anomalously methylated cfDNA fragment that overlaps the target genomic region, and wherein the target genomic region is determined to be anomalously methylated in cancer training samples relative to non-cancer training samples based on criteria comprising $N_{cancer}$ and $N_{non-cancer}$, wherein:

$N_{cancer}$, for each CpG, site is a number of cancer samples that include a cfDNA fragment covering the CpG site in the cfDNA fragment that (1) has at least 4 CpG sites, wherein at least 70% of the CpG sites are methylated or unmethylated and (2) has a p-value rarity in non-cancerous samples of below a threshold value; and $N_{non-cancer}$, for each CpG, site is a number of non-cancer samples that include a cfDNA fragment covering the CpG site in the cfDNA fragment that (1) has at least 4 CpG sites, wherein at least 70% of the sites are methylated or unmethylated and (2) has a p-value rarity in non-cancerous samples of below a threshold value.

3. The method of claim 2, wherein each of the at least 500 target genomic regions is determined to be anomalously methylated based on criteria positively correlated with $N_{cancer}$ and negatively correlated with $N_{non-cancer}$.

4. The method of claim 2, wherein each of the at least 500 target genomic regions is determined to be anomalously methylated based on a score, wherein the score is calculated as $(N_{cancer}+1)/(N_{cancer}+N_{non-cancer}+2)$.

5. The method of claim 1, wherein the at least 500 target genomic regions comprise all genomic regions identified in List 1.

6. The method of claim 1, wherein the at least 500 target genomic regions comprise at least 500 of genomic regions identified in List 1.

7. The method of claim 1, wherein the at least 500 target genomic regions comprise at least 500 of genomic regions identified in List 2.

8. The method of claim 1, wherein the at least 500 target genomic regions comprise at least 500 of genomic regions identified in List 3.

9. The method of claim 1, wherein the at least 500 target genomic regions comprise at least 500 of genomic regions identified in List 5.

10. The method of claim 1, wherein the at least 500 target genomic regions comprise at least 500 of genomic regions identified in List 8.

11. The method of claim 1, wherein the at least 500 target genomic regions comprise at least 500 genomic regions identified in List 4.

12. The method of claim 1, wherein the at least 500 target genomic regions comprise at least 500 genomic regions identified in List 6.

13. The method of claim 1, further comprising:
e) generating a set of test features from the set of sequence reads; and
f) applying the set of test features to a classifier configured to determine:
a presence or absence of cancer;
a stage of cancer; or
a type of cancer.

14. The method of claim 13, wherein the classifier comprises a model that is trained by a training process with a cancer set of training fragments from one or more training subjects with a cancer and a non-cancer set of training fragments from one or more training subjects without cancer, wherein both the cancer set of training fragments and the non-cancer set of training fragments comprise a plurality of training fragments.

15. The method of claim 14, wherein the one or more training subjects with a cancer comprise training subjects collectively having at least 5 cancer types selected from the group consisting of lung cancer, breast cancer, prostate cancer, lymphoid neoplasm, colorectal cancer, pancreas & gallbladder cancer, uterine cancer, upper gastrointestinal tract cancer, head & neck cancer, renal cancer, ovarian cancer, multiple myeloma, liver & bile duct cancer, sarcoma, bladder & urothelial cancer, anorectal cancer, cervical cancer, and melanoma, myeloid neoplasm and thyroid cancer.

16. The method of claim 14, wherein the training process comprises:
obtaining sequence information of training fragments from a plurality of training subjects;
for each training fragment, determining whether that training fragment is hypomethylated or hypermethylated, wherein each of the hypomethylated and the hypermethylated training fragments comprises at least five CpG sites with at least 80% of the CpG sites being unmethylated or methylated, respectively,
for each training subject, generating a training feature vector for each hypomethylated training fragment and each hypermethylated training fragment, and
training the model with the training feature vectors from the one or more training subjects without cancer and the training feature vectors from the one or more training subjects with a cancer.

17. The method of claim 14, wherein the model comprises a kernel logistic regression classifier, a random forest classifier, a mixture model, a convolutional neural network, or an autoencoder model.

18. The method of claim 13, wherein the classifier has an area under a receiver operating characteristic curve for detecting the presence or absence of cancer of greater than 0.75.

19. The method of claim 13, wherein at a specificity of 0.99, the classifier has a sensitivity for detecting the presence or absence of cancer of at least 40%.

20. The method of claim 13, wherein at a specificity of 0.994, the classifier has a sensitivity for one or more cancers selected from the group consisting of:
lung cancer, wherein the sensitivity for detecting lung cancer is at least 60%;
colorectal cancer, wherein the sensitivity for detecting colorectal cancer is at least 70%;
pancreatic or gallbladder cancer, wherein the sensitivity for detecting pancreatic or gallbladder cancer is at least 70%;
head and neck cancer, wherein the sensitivity for detecting head and neck cancer is at least 80%;
ovarian cancer, wherein the sensitivity for detecting lung ovarian cancer is at least 60%;
multiple myeloma, wherein the sensitivity for detecting multiple myeloma is at least 60%;
upper GI tract cancer, wherein the sensitivity for detecting upper GI tract cancer is at least 75%;

liver or bile duct cancer, wherein the sensitivity for detecting liver or bile duct cancer is at least 70%; and
lymphoid neoplasm, wherein the sensitivity for detecting lymphoid neoplasm is at least 60%.

21. The method of claim 13, wherein a presence of cancer is detected at a specificity of at least 0.99, and an accuracy of assigning a cancer type among at least 10 cancer types is at least 85%.

22. The method of claim 21, wherein the at least 10 cancer types are selected from lung cancer, colorectal cancer, lymphoid neoplasm, breast cancer, pancreas & gallbladder cancer, head & neck cancer, upper gastrointestinal tract cancer, ovarian cancer, liver & bile duct cancer, uterine cancer, prostate cancer, multiple myeloma, renal cancer, anorectal cancer, bladder & urothelial cancer, sarcoma, cervical cancer, and melanoma.

23. The method of claim 13, wherein a presence of cancer is detected at a specificity of 0.99, and an accuracy of assigning a cancer type for at least 10 cancer types, wherein the at least 10 cancer types are selected from the group consisting of:
  a cancer type of lung cancer, wherein the accuracy of assigning a cancer type of lung cancer is at least 90%;
  a cancer type of colorectal cancer, wherein the accuracy of assigning a cancer type of colorectal cancer is at least 90%;
  lymphoid neoplasm, wherein the accuracy of assigning a cancer type of lymphoid neoplasm is at least 90%;
  breast cancer, wherein the accuracy of assigning a cancer type of breast cancer is at least 90%;
  pancreas & gallbladder cancer, wherein the accuracy of assigning a cancer type of pancreas & gallbladder cancer is at least 85%
  head & neck cancer, wherein the accuracy of assigning a cancer type of head & neck cancer is at least 80%;
  upper gastrointestinal tract cancer, wherein the accuracy of assigning a cancer type of upper gastrointestinal tract cancer is at least 80%;
  ovarian cancer, wherein the accuracy of assigning a cancer type of ovarian cancer is at least 85%;
  liver & bile duct cancer, wherein the accuracy of assigning a cancer type of liver & bile duct cancer is at least 70%
  uterine cancer, wherein the accuracy of assigning a cancer type of uterine cancer is at least 90%;
  prostate cancer, wherein the accuracy of assigning a cancer type of prostate cancer is at least 85%;
  multiple myeloma, wherein the accuracy of assigning a cancer type of multiple myeloma is at least 90%; and
  renal cancer, wherein the accuracy of assigning a cancer type of renal cancer is at least 90%.

24. The method of claim 1, wherein for each probe of the pairs of probes, the first portion is at least 30 nucleotides in length, and the second portion is at least 15 nucleotides in length.

25. The method of claim 1, wherein for each probe of the pairs of probes, the second portion is at least 50 nucleotides in length.

26. The method of claim 24, wherein for each probe of the pairs of probes, the first portion and second portion together are at least 65 nucleotides in length.

27. The method of claim 24, wherein each probe of the pairs of probes is less than 300 nucleotides in length.

28. The method of claim 1, wherein the target genomic regions are human genomic regions, and further wherein at least one probe for each of the at least 500 target genomic regions (a) comprises a length of at least 45 bases, and (b) does not comprise a contiguous 45 bases with at least 90% sequence complementarity to 20 off-target regions in a GRCh37/hg19 genome.

* * * * *